US009670472B1

(12) United States Patent
Yang et al.

(10) Patent No.: US 9,670,472 B1
(45) Date of Patent: *Jun. 6, 2017

(54) 2G16 GLUCOAMYLASE COMPOSITIONS AND METHODS

(71) Applicant: Fornia BioSolutions, Inc., Hayward, CA (US)

(72) Inventors: Jie Yang, Foster City, CA (US); Goutami Banerjee, Hayward, CA (US); Khin Oo, Daly City, CA (US); Xiyun Zhang, Fremont, CA (US)

(73) Assignee: FORNIA BIOSOLUTIONS, INC, Hayward, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 15/380,959

(22) Filed: Dec. 15, 2016

Related U.S. Application Data

(63) Continuation-in-part of application No. 15/230,292, filed on Aug. 5, 2016.

(51) Int. Cl.
*C12N 9/34* (2006.01)
*C12P 19/20* (2006.01)
*C12P 19/02* (2006.01)

(52) U.S. Cl.
CPC ............ *C12N 9/2428* (2013.01); *C12P 19/02* (2013.01); *C12P 19/20* (2013.01); *C12Y 302/01003* (2013.01)

(58) Field of Classification Search
None
See application file for complete search history.

(56) References Cited

FOREIGN PATENT DOCUMENTS

| WO | WO 2011/020852 A1 | 2/2011 |
| WO | WO 2011/022465 A1 | 2/2011 |
| WO | WO 2014/028358 A1 | 2/2014 |

OTHER PUBLICATIONS

U.S. Appl. No. 15/230,248, filed Aug. 5, 2016.
U.S. Appl. No. 15/230,292, filed Aug. 5, 2016; and.
U.S. Appl. No. 15/380,900, filed Dec. 15, 2016.
GenBank Accession No. KKA29558.1, published Apr. 3, 2015.
International Search Report dated Mar. 10, 2017 for Application No. PCT/US2016/067032, 12 pages.

*Primary Examiner* — Robert Mondesi
*Assistant Examiner* — Richard Ekstrom
(74) *Attorney, Agent, or Firm* — Robin M. Silva; Morgan, Lewis & Bockius LLP

(57) ABSTRACT

The invention is directed to novel glucoamylases.

6 Claims, 22 Drawing Sheets

Fig. 3

| Collection (TpGlucoamylase #) | Colony Tracking Number | Thermostability Improvement PF at pH4.5, 40°C, 48 hrs after preincubation at 57°C for 10mins | AA Mutation w.r.t. G1P (WT) | SEQ ID NO: |
|---|---|---|---|---|
| G1C1 | CL00002146 | 1.0 | | 1 (G16 TpGlucoamylase G1P) |
| G1C1 | CL00004076 | 1.5 | A111G | 3 (G16 TpGlucoamylase G2P) |
| G1C1 | CL00004028 | 1.4 | A111G/Q547A | 7 |
| G1C1 | CL00004087 | 1.8 | A111G/Y179F | 9 |
| G1C1 | CL00004111 | 1.2 | I69M/A111G/Q547H | 11 |
| G1C1 | CL00004139 | 1.4 | I69L/A111G | 13 |
| G1C1 | CL00004164 | 1.6 | A111G/Q419P | 15 |
| G1C1 | CL00004173 | 1.5 | A111G/F555Y | 17 |
| G1C1 | CL00004180 | 1.6 | I69L/A111G/Q547A | 19 |
| G1C1 | CL00004190 | 1.4 | A111G/L311V | 21 |
| G1C1 | CL00004195 | 1.4 | A111G/I286A/T288H/L311V/F516L/Q547A | 23 |
| G1C1 | CL00004243 | 1.3 | Q547A | 25 |
| G1C1 | CL00004280 | 1.2 | A111G/F516L/F555Y | 27 |
| G1C1 | CL00004332 | 1.3 | A111G/A262S/Q547A | 29 |
| G1C1 | CL00004396 | 1.4 | A111G/Y179F/A262S | 31 |
| G1C1 | CL00004405 | 1.3 | A111G/Y147W | 33 |
| G1C2 | CL00004548 | 1.6 | A117V/I564V | 35 |
| G1C2 | CL00004562 | 1.5 | T98S/A117V/I564V | 37 |
| G1C2 | CL00004574 | 1.5 | A117V | 39 |
| G1C2 | CL00004612 | 1.3 | A117V/Q284H/T287N/I564V | 41 |
| G1C2 | CL00004664 | 1.2 | I564V | 43 |
| G1C2 | CL00004761 | 1.6 | T98S/A117V | 45 |
| G1C2 | CL00004772 | 1.2 | V545L | 47 |
| G1C2 | CL00004828 | 1.4 | A117V/F553Y | 49 |
| G1C2 | CL00004844 | 1.4 | A117V/S434T | 51 |
| G1C2 | CL00004868 | 1.2 | A117V/Y197H/V545L | 53 |
| G1C2 | CL00004885 | 1.2 | T98S/A117V/F553Y | 55 |

Fig. 4A

| Collection | Colony Tracking Number | Thermostability Improvement | AA Mutation w.r.t. G2P | SEQ ID NO: |
|---|---|---|---|---|
| | | PF at pH4.5, 40°C, 48hrs after preincubation at 59°C for 10mins | | |
| G2C1 | CL00016320 | 1.4 | S30N | 57 |
| G2C1 | CL00016361 | 2.7 | T49R | 59 |
| G2C1 | CL00016436 | 2.0 | L44I | 61 |
| G2C1 | CL00016454 | 1.7 | A117P | 63 |
| G2C1 | CL00016472 | 3.1 | S30P | 5 (G16 TpGlucoamylase G3P) |
| G2C1 | CL00016475 | 1.2 | K23N | 65 |
| G2C1 | CL00016506 | 2.1 | T31N | 67 |
| G2C1 | CL00016557 | 2.2 | T31E | 69 |
| G2C1 | CL00016562 | 1.2 | D53N | 71 |
| G2C1 | CL00016595 | 1.8 | N51D | 73 |
| G2C1 | CL00016641 | 2.0 | S39A | 75 |
| G2C1 | CL00016684 | 1.5 | K23R | 77 |
| G2C1 | CL00016693 | 1.3 | A35L | 79 |
| G2C1 | CL00016720 | 1.7 | T31Q | 81 |
| G2C1 | CL00016727 | 1.4 | T31K | 83 |
| G2C1 | CL00016755 | 1.5 | S50I | 85 |
| G2C1 | CL00016817 | 1.2 | S50Y | 87 |
| G2C1 | CL00016854 | 1.7 | T49K | 89 |
| G2C1 | CL00016961 | 1.3 | K23Y | 91 |
| G2C1 | CL00017089 | 1.6 | S50E | 93 |
| G2C1 | CL00017126 | 1.4 | S36R | 95 |
| G2C1 | CL00017170 | 1.5 | S30D | 97 |
| G2C2 | CL00017342 | 1.2 | S530E | 99 |
| G2C2 | CL00017353 | 1.2 | T540S | 101 |
| G2C2 | CL00017376 | 1.2 | S535E | 103 |
| G2C2 | CL00017379 | 1.3 | S530G | 105 |
| G2C2 | CL00017499 | 1.2 | T533K | 107 |
| G2C2 | CL00017545 | 1.2 | A534L | 109 |
| G2C2 | CL00017619 | 1.2 | S535T | 111 |
| G2C2 | CL00017633 | 1.5 | Q423P | 113 |
| G2C2 | CL00017677 | 1.2 | Q423M | 115 |
| G2C2 | CL00017800 | 1.4 | Q121A | 117 |

Fig 4B

| Collection | Colony Tracking Number | Thermostability Improvement<br><br>PF at pH4.5, 40°C, 48hrs after preincubation at 59°C for 10mins | AA Mutation w.r.t. G2P | SEQ ID NO: |
|---|---|---|---|---|
| G2C2 | CL00017915 | 1.3 | S535G | 119 |
| G2C2 | CL00017966 | 1.2 | T540A | 121 |
| G2C2 | CL00017998 | 1.4 | L119M | 123 |
| G2C2 | CL00018049 | 1.5 | Q121P | 125 |
| G2C2 | CL00018121 | 1.2 | S535K | 127 |
| G2C3 | CL00018170 | 1.2 | V585P | 129 |
| G2C3 | CL00018240 | 1.2 | V583F | 131 |
| G2C3 | CL00018397 | 1.3 | G577R | 133 |
| G2C3 | CL00018457 | 1.2 | T581K | 135 |
| G2C3 | CL00018469 | 1.3 | V576I | 137 |
| G2C3 | CL00018672 | 1.3 | K572E | 139 |
| G2C3 | CL00018828 | 1.5 | V576L | 141 |
| G2C3 | CL00018997 | 1.3 | S588Q | 143 |
| G2C3 | CL00019056 | 1.2 | T581I | 145 |

Fig. 5A

| Collection | Colony Tracking Number | Thermostability Improvement PF at pH4.5, 40°C, 21-24hrs after preincubation at 62°C for 10mins | AA Mutation w.r.t. G3P | SEQ ID NO: |
|---|---|---|---|---|
| TpGlucoamylase-G3C1 | CL00019320 | 2.2 | N413S | 147 |
| TpGlucoamylase-G3C1 | CL00019387 | 1.9 | N413D | 149 |
| TpGlucoamylase-G3C1 | CL00019415 | 1.2 | T362A | 151 |
| TpGlucoamylase-G3C1 | CL00019452 | 1.1 | G457P | 153 |
| TpGlucoamylase-G3C1 | CL00019453 | 1.1 | T463F | 155 |
| TpGlucoamylase-G3C1 | CL00019474 | 1.2 | A317K | 157 |
| TpGlucoamylase-G3C1 | CL00019610 | 1.1 | T388K | 159 |
| TpGlucoamylase-G3C1 | CL00020066 | 1.1 | T388I | 161 |
| TpGlucoamylase-G3C1 | CL00020100 | 1.1 | T388Y | 163 |
| TpGlucoamylase-G3C1 | CL00020102 | 1.1 | G457N | 165 |
| TpGlucoamylase-G3C1 | CL00020149 | 1.2 | P186Y | 167 |
| TpGlucoamylase-G3C4-G3C5 | CL00020167 | 2.1 | K23R/S39A/N51D | 169 |
| TpGlucoamylase-G3C4-G3C5 | CL00020218 | 1.8 | K23R/S39A/S50E/L119M/Q121P | 171 |
| TpGlucoamylase-G3C4-G3C5 | CL00020270 | 1.6 | K23R/T49K/S50E | 173 |
| TpGlucoamylase-G3C4-G3C5 | CL00020288 | 2.0 | K23R/S50E/N51D/A117V/L119M | 175 |
| TpGlucoamylase-G3C4-G3C5 | CL00020306 | 1.8 | L119M/Q121A | 177 |
| TpGlucoamylase-G3C4-G3C5 | CL00020315 | 1.9 | S39A/S50I/N51D/Q423P | 179 |
| TpGlucoamylase-G3C4-G3C5 | CL00020318 | 1.4 | Q423P | 181 |
| TpGlucoamylase-G3C4-G3C5 | CL00020323 | 1.7 | K23R/Q423P | 183 |
| TpGlucoamylase-G3C4-G3C5 | CL00020336 | 1.4 | A117P | 185 |
| TpGlucoamylase-G3C4-G3C5 | CL00020355 | 1.8 | S39A/A117V | 187 |
| TpGlucoamylase-G3C4-G3C5 | CL00020386 | 2.1 | S39A/T49R/L119M | 189 |
| TpGlucoamylase-G3C4-G3C5 | CL00020416 | 2.2 | T49K/Q423P | 191 |
| TpGlucoamylase-G3C4-G3C5 | CL00020450 | 1.9 | N51D/L119M | 193 |
| TpGlucoamylase-G3C4-G3C5 | CL00020452 | 2.0 | A117V/L119M/Q121P/Q423P | 195 |
| TpGlucoamylase-G3C4-G3C5 | CL00020483 | 1.9 | T49R/A117P/L119M | 197 |
| TpGlucoamylase-G3C4-G3C5 | CL00020486 | 1.1 | L119M | 199 |

Fig 5B

| Collection | Colony Tracking Number | Thermostability Improvement PF at pH4.5, 40°C, 21-24hrs after preincubation at 62°C for 10mins | AA Mutation w.r.t. G3P | SEQ ID NO: |
|---|---|---|---|---|
| TpGlucoamylase-G3C4-G3C5 | CL00020487 | 2.7 | S39A/T49R/S50I/N51D | 201 |
| TpGlucoamylase-G3C4-G3C5 | CL00020492 | 1.2 | A117V | 203 |
| TpGlucoamylase-G3C4-G3C5 | CL00020544 | 1.3 | S39A | 205 |
| TpGlucoamylase-G3C4-G3C5 | CL00020555 | 2.9 | K23R/S39A/T49K/L119M/Q423P | 207 (G16 TpGlucoamylase G4P) |
| TpGlucoamylase-G3C4-G3C5 | CL00020558 | 2.4 | K23R/T49R | 209 |
| TpGlucoamylase-G3C4-G3C5 | CL00020574 | 2.3 | K23R/N51D/L119M/Q121P | 211 |
| TpGlucoamylase-G3C4-G3C5 | CL00020744 | 3.0 | L44I/A117V/L119M | 213 |
| TpGlucoamylase-G3C4-G3C5 | CL00020876 | 1.6 | T31K/L119M/Q423P | 215 |
| TpGlucoamylase-G3C4-G3C5 | CL00020973 | 1.9 | L44I | 217 |
| TpGlucoamylase-G3C2 | CL00021116 | 1.6 | A415N | 219 |
| TpGlucoamylase-G3C2 | CL00021226 | 1.1 | T400K | 221 |
| TpGlucoamylase-G3C2 | CL00021526 | 1.6 | A415D | 223 |
| TpGlucoamylase-G3C2 | CL00021667 | 1.5 | A415Y | 225 |
| TpGlucoamylase-G3C2 | CL00021717 | 1.1 | L347K | 227 |
| TpGlucoamylase-G3C2 | CL00021908 | 1.6 | A415T | 229 |
| TpGlucoamylase-G3C2 | CL00021943 | 1.7 | A415W | 231 |
| TpGlucoamylase-G3C2 | CL00022008 | 1.6 | A415F | 233 |
| TpGlucoamylase-G3C2 | CL00022111 | 1.1 | T309Q | 235 |
| TpGlucoamylase-G3C3 | CL00022195 | 1.1 | S385L | 237 |
| TpGlucoamylase-G3C3 | CL00022224 | 1.2 | S385Q | 239 |
| TpGlucoamylase-G3C3 | CL00022403 | 1.1 | S250E | 241 |
| TpGlucoamylase-G3C3 | CL00022407 | 1.2 | T309E | 243 |
| TpGlucoamylase-G3C3 | CL00022549 | 1.5 | T309D | 245 |
| TpGlucoamylase-G3C3 | CL00022582 | 1.1 | S14Q | 247 |
| TpGlucoamylase-G3C3 | CL00022777 | 1.1 | S250D | 249 |

Fig 5C

| Collection | Colony Tracking Number | Thermostability Improvement PF at pH4.5, 40°C, 21-24hrs after preincubation at 62°C for 10mins | AA Mutation w.r.t. G3P | SEQ ID NO: |
|---|---|---|---|---|
| TpGlucoamylase-G3C3 | CL00022849 | 1.1 | S250K | 251 |
| TpGlucoamylase-G3C3 | CL00023051 | 1.1 | A300Q | 253 |
| TpGlucoamylase-G3C3 | CL00023110 | 1.2 | A300L | 255 |

Fig. 6A

| Collection | Colony Tracking Number | Thermostability Improvement PF at pH4.5, 40°C, 22hrs after preincubation at 67°C for 10mins | AA Mutation w.r.t. G4P | SEQ ID NO: |
|---|---|---|---|---|
| TpGlucoamylase-G4C1 | CL00023236 | 1.4 | T31E/N51D/Q121P | 257 |
| TpGlucoamylase-G4C1 | CL00023239 | 2.6 | T31E/(T/K)49R/N413D | 259 |
| TpGlucoamylase-G4C1 | CL00023294 | 1.4 | T31E/(T/K)49R/N51D | 261 |
| TpGlucoamylase-G4C1 | CL00023295 | 2.0 | L44I/A117V | 263 |
| TpGlucoamylase-G4C1 | CL00023354 | 2.4 | Q121P/N413S | 265 |
| TpGlucoamylase-G4C1 | CL00023407 | 2.2 | N413D | 267 |
| TpGlucoamylase-G4C1 | CL00023426 | 2.6 | (T/K)49R/N51D/N413S | 269 |
| TpGlucoamylase-G4C1 | CL00023478 | 2.2 | T31E/(T/K)49R/A117V/N413S | 271 |
| TpGlucoamylase-G4C1 | CL00023479 | 2.6 | T31E/L44I/N51D/A117V | 273 |
| TpGlucoamylase-G4C1 | CL00023484 | 2.2 | T31E/(T/K)49R/N51D/N413D | 275 |
| TpGlucoamylase-G4C1 | CL00023486 | 2.6 | L44I/(T/K)49R/N51D/N413D | 277 |
| TpGlucoamylase-G4C1 | CL00023488 | 1.2 | T31E/(T/K)49R/S50N/N51D/C157W | 279 |
| TpGlucoamylase-G4C1 | CL00023516 | 1.5 | (T/K)49R/N51D | 281 |
| TpGlucoamylase-G4C1 | CL00023614 | 1.8 | L44I/(T/K)49R/N51D | 283 |
| TpGlucoamylase-G4C1 | CL00023622 | 2.1 | L44I/(T/K)49R/A117V | 285 |
| TpGlucoamylase-G4C1 | CL00023672 | 2.5 | L44I/N51D/A117V/Q121A | 287 |
| TpGlucoamylase-G4C1 | CL00023679 | 2.1 | T31E/L44I/(T/K)49R/A117V | 289 |
| TpGlucoamylase-G4C1 | CL00023711 | 2.5 | L44I/N51D/A117V | 291 |
| TpGlucoamylase-G4C1 | CL00023719 | 3.5 | T31E/L44I/(T/K)49R/N51D/A117V/N413S | 293 |
| TpGlucoamylase-G4C1 | CL00023752 | 2.4 | A117V/Q121A/N413D | 295 |
| TpGlucoamylase-G4C1 | CL00023756 | 2.7 | T31E/L44I/(T/K)49R/A117V/Q121P | 297 |
| TpGlucoamylase-G4C1 | CL00023779 | 1.4 | N51D | 299 |
| TpGlucoamylase-G4C1 | CL00023782 | 3.0 | T31E/L44I/(T/K)49R/Q121P/N413S | 301 |
| TpGlucoamylase-G4C1 | CL00023800 | 1.6 | L44I/(T/K)49R/Q121P | 303 |

Fig 6B

| Collection | Colony Tracking Number | Thermostability Improvement PF at pH4.5, 40°C, 22hrs after preincubation at 67°C for 10mins | AA Mutation w.r.t. G4P | SEQ ID NO: |
|---|---|---|---|---|
| TpGlucoamylase-G4C1 | CL00023809 | 2.9 | L44I/(T/K)49R/N413S | 305 |
| TpGlucoamylase-G4C1 | CL00023829 | 3.5 | L44I/T49R/N51D/A117V/N413S | 307 (G16 TpGlucoamylase G5P) |
| TpGlucoamylase-G4C1 | CL00023840 | 2.5 | N51D/A117V/N413S | 309 |
| TpGlucoamylase-G4C1 | CL00023848 | 2.5 | N51D/N413S | 311 |
| TpGlucoamylase-G4C1 | CL00023883 | 1.7 | T31E/L44I/(T/K)49R | 313 |

Fig. 7

| Collection | Colony Tracking Number | Thermostability Improvement PF at pH4.5, 40°C, 22hrs after preincubation at 72°C for 10mins | AA Mutation w.r.t. G5P | Alias |
|---|---|---|---|---|
| TpGlucoamylase-G5C1 | CL00023944 | 1.1 | T31E/Q121A/S413D | 315 |
| TpGlucoamylase-G5C1 | CL00023972 | 2.0 | Q121P/S413D/A415N | 317 |
| TpGlucoamylase-G5C1 | CL00024013 | 2.1 | A415W | 319 |
| TpGlucoamylase-G5C1 | CL00024024 | 1.8 | A415F | 321 |
| TpGlucoamylase-G5C1 | CL00024038 | 1.2 | T309D/A415S | 323 |
| TpGlucoamylase-G5C1 | CL00024053 | 1.4 | T309E | 325 |
| TpGlucoamylase-G5C1 | CL00024074 | 2.0 | T309E/A415W | 327 |
| TpGlucoamylase-G5C1 | CL00024079 | 1.7 | A415D | 329 |
| TpGlucoamylase-G5C1 | CL00024138 | 1.9 | E83K/D118N/A415W | 331 |
| TpGlucoamylase-G5C1 | CL00024162 | 1.1 | R49K | 333 |
| TpGlucoamylase-G5C1 | CL00024166 | 1.9 | T31E/A415F | 335 |
| TpGlucoamylase-G5C1 | CL00024191 | 1.8 | A415Y | 337 |
| TpGlucoamylase-G5C1 | CL00024274 | 2.0 | T31E/T309E/A415W | 339 |
| TpGlucoamylase-G5C1 | CL00024416 | 2.1 | T31E/R49K/Q121A/A415W | 341 |
| TpGlucoamylase-G5C1 | CL00024548 | 1.7 | T31E/A415Y | 343 |
| TpGlucoamylase-G5C1 | CL00024639 | 1.6 | R49K/T309E/A415D | 345 |
| TpGlucoamylase-G5C1 | CL00024696 | 1.7 | T31E/R49K/T309D/A415F/L526F | 347 |
| TpGlucoamylase-G5C1 | CL00024866 | 1.3 | T31E/T309D | 349 |
| TpGlucoamylase-G5C1 | CL00024916 | 2.1 | Q121P/T309E/A415F | 351 |
| TpGlucoamylase-G5C1 | CL00025095 | 1.6 | S413D/A415N | 353 |
| TpGlucoamylase-G5C1 | CL00025109 | 2.0 | T31E/Q121P/A415Y | 355 |
| TpGlucoamylase-G5C1 | CL00025145 | 1.9 | Q121A/A415Y | 357 |
| TpGlucoamylase-G5C1 | CL00025216 | 2.1 | T309D/A415W | 359 |
| TpGlucoamylase-G5C1 | CL00025225 | 2.3 | Q121P/T309D/A415Y | 361 (G1b TpGlucoamylase G6P) |

SP:   AA 1-22
Catalytic Domain (GH15):     AA 42-457
Starch Binding Domain (CBM20):   AA 515-606
Catalytic Residues:    D202 (Proton acceptor), E205 (Proton donor)
Substrate Binding Residues:    W148

//

1                                                       50
CL00002146    MVFLKSAIAA STWLLAATGV VASPVSKRAT LDEFISTERP LALEKLLCNI
CL00004076    MVFLKSAIAA STWLLAATGV VASPVSKRAT LDEFISTERP LALEKLLCNI
CL00016472    MVFLKSAIAA STWLLAATGV VASPVSKRAT LDEFISTERP LALEKLLCNI
CL00020555    MVFLKSAIAA STWLLAATGV VASPVSKRAT LDEFISTERP LALERLLCNI
CL00023829    MVFLKSAIAA STWLLAATGV VASPVSKRAT LDEFISTERP LALERLLCNI
CL00025225    MVFLKSAIAA STWLLAATGV VASPVSKRAT LDEFISTERP LALERLLCNI 51                                                     100
CL00002146    GSTGCRASGA SSGVVLASPS TSNPDYYYTW TRDAALVFKE IVDSVETNTT
CL00004076    GSTGCRASGA SSGVVLASPS TSNPDYYYTW TRDAALVFKE IVDSVETNTT
CL00016472    GPTGCRASGA SSGVVLASPS TSNPDYYYTW TRDAALVFKE IVDSVETNTT
CL00020555    GPTGCRASGA ASGVVLASPS KSNPDYYYTW TRDAALVFKE IVDSVETNTT
CL00023829    GPTGCRASGA ASGVVIASPS RSDPDYYYTW TRDAALVFKE IVDSVETNTT
CL00025225    GPTGCRASGA ASGVVIASPS RSDPDYYYTW TRDAALVFKE IVDSVETNTT 101                                                    150
CL00002146    LLLPEIENYV TAQAYLQTVT NPSGSLSDGA GLAEPKFNAD LTQFTGAWGR
CL00004076    LLLPEIENYV TAQAYLQTVT NPSGSLSDGA GLGEPKFNAD LTQFTGAWGR
CL00016472    LLLPEIENYV TAQAYLQTVT NPSGSLSDGA GLGEPKFNAD LTQFTGAWGR
CL00020555    LLLPEIENYV TAQAYLQTVT NPSGSLSDGA GLGEPKFNAD MTQFTGAWGR
CL00023829    LLLPEIENYV TAQAYLQTVT NPSGSLSDGA GLGEPKFNVD MTQFTGAWGR
CL00025225    LLLPEIENYV TAQAYLQTVT NPSGSLSDGA GLGEPKFNVD MTPFTGAWGR 151                                                    200
CL00002146    PQRDGPALRA TAMIAYYNYL LNNNATTDCG LWQIIQNDLN YVAQYWNQTG
CL00004076    PQRDGPALRA TAMIAYYNYL LNNNATTDCG LWQIIQNDLN YVAQYWNQTG
CL00016472    PQRDGPALRA TAMIAYYNYL LNNNATTDCG LWQIIQNDLN YVAQYWNQTG
CL00020555    PQRDGPALRA TAMIAYYNYL LNNNATTDCG LWQIIQNDLN YVAQYWNQTG
CL00023829    PQRDGPALRA TAMIAYYNYL LNNNATTDCG LWQIIQNDLN YVAQYWNQTG
CL00025225    PQRDGPALRA TAMIAYYNYL LNNNATTDCG LWQIIQNDLN YVAQYWNQTG 201                                                    250
CL00002146    YDLWEEVPGS SFFTVAAQYR ALVEGSTLAA KLGKSHSAYD TVAPQILCYL
```

Fig 8B

```
CL00004076  YDLwEEVPGS SFFTVAAQYR ALVEGSTLAA KLGKSHSAYD TVAPQILCYL
CL00016472  YDLwEEVPGS SFFTVAAQYR ALVEGSTLAA KLGKSHSAYD TVAPQILCYL
CL00020555  YDLwEEVPGS SFFTVAAQYR ALVEGSTLAA KLGKSHSAYD TVAPQILCYL
CL00023829  YDLwEEVPGS SFFTVAAQYR ALVEGSTLAA KLGKSHSAYD TVAPQILCYL
CL00025225  YDLwEEVPGS SFFTVAAQYR ALVEGSTLAA KLGKSHSAYD TVAPQILCYL 251                                                300
CL00002146  QSFWSSSKGY IVANTQTASW VSRSGLDANT PLTAIHLFDP ELGCDDSTFQ
CL00004076  QSFWSSSKGY IVANTQTASW VSRSGLDANT PLTAIHLFDP ELGCDDSTFQ
CL00016472  QSFWSSSKGY IVANTQTASW VSRSGLDANT PLTAIHLFDP ELGCDDSTFQ
CL00020555  QSFWSSSKGY IVANTQTASW VSRSGLDANT PLTAIHLFDP ELGCDDSTFQ
CL00023829  QSFWSSSKGY IVANTQTASW VSRSGLDANT PLTAIHLFDP ELGCDDSTFQ
CL00025225  QSFWSSSKGY IVANTQTASW VSRSGLDANT PLTAIHLFDP ELGCDDSTFQ 301                                                350
CL00002146  PCSPKQLITT KKLVDSFRSI YAINSGKSAG TALAVGRYAE DVYYNGNPWY
CL00004076  PCSPKQLITT KKLVDSFRSI YAINSGKSAG TALAVGRYAE DVYYNGNPWY
CL00016472  PCSPKQLITT KKLVDSFRSI YAINSGKSAG TALAVGRYAE DVYYNGNPWY
CL00020555  PCSPKQLITT KKLVDSFRSI YAINSGKSAG TALAVGRYAE DVYYNGNPWY
CL00023829  PCSPKQLITT KKLVDSFRSI YAINSGKSAG TALAVGRYAE DVYYNGNPWY
CL00025225  PCSPKQLITT KKLVDSFRSI YAINSGKSAG DALAVGRYAE DVYYNGNPWY 351                                                400
CL00002146  LCTLAVAEQL YDAVYTWKLE GSITVTSVSL PFFTDLLPSL TTGTYASGST
CL00004076  LCTLAVAEQL YDAVYTWKLE GSITVTSVSL PFFTDLLPSL TTGTYASGST
CL00016472  LCTLAVAEQL YDAVYTWKLE GSITVTSVSL PFFTDLLPSL TTGTYASGST
CL00020555  LCTLAVAEQL YDAVYTWKLE GSITVTSVSL PFFTDLLPSL TTGTYASGST
CL00023829  LCTLAVAEQL YDAVYTWKLE GSITVTSVSL PFFTDLLPSL TTGTYASGST
CL00025225  LCTLAVAEQL YDAVYTWKLE GSITVTSVSL PFFTDLLPSL TTGTYASGST 401                                                450
CL00002146  TFESIISAVT TYADGFVSIV QTYTPSDGAL SEQYNKANGQ QLSAQDLTWS
CL00004076  TFESIISAVT TYADGFVSIV QTYTPSDGAL SEQYNKANGQ QLSAQDLTWS
CL00016472  TFESIISAVT TYADGFVSIV QTYTPSDGAL SEQYNKANGQ QLSAQDLTWS
CL00020555  TFESIISAVT TYADGFVSIV QTYTPSDGAL SEQYNKANGQ QLSAPDLTWS
CL00023829  TFESIISAVT TYADGFVSIV QTYTPSDGAL SEQYSKANGQ QLSAPDLTWS
CL00025225  TFESIISAVT TYADGFVSIV QTYTPSDGAL SEQYSKYNGQ QLSAPDLTWS 451                                                500
CL00002146  YAAFLSATER RDSVVPAGWA GASSVSVPGA CAATTVVGTY AAASNCGTPG
CL00004076  YAAFLSATER RDSVVPAGWA GASSVSVPGA CAATTVVGTY AAASNCGTPG
CL00016472  YAAFLSATER RDSVVPAGWA GASSVSVPGA CAATTVVGTY AAASNCGTPG
CL00020555  YAAFLSATER RDSVVPAGWA GASSVSVPGA CAATTVVGTY AAASNCGTPG
CL00023829  YAAFLSATER RDSVVPAGWA GASSVSVPGA CAATTVVGTY AAASNCGTPG
CL00025225  YAAFLSATER RDSVVPAGWA GASSVSVPGA CAATTVVGTY AAASNCGTPG 501                                                550
CL00002146  SGSGGNGGSS GNALVTFNEL ATTYYGENIK LVGSTAAFGS WSPSAGILLS
CL00004076  SGSGGNGGSS GNALVTFNEL ATTYYGENIK LVGSTAAFGS WSPSAGILLS
CL00016472  SGSGGNGGSS GNALVTFNEL ATTYYGENIK LVGSTAAFGS WSPSAGILLS
CL00020555  SGSGGNGGSS GNALVTFNEL ATTYYGENIK LVGSTAAFGS WSPSAGILLS
CL00023829  SGSGGNGGSS GNALVTFNEL ATTYYGENIK LVGSTAAFGS WSPSAGILLS
```

Fig 8C

```
CL00025225  SGSGGNGGSS GNALVTFNEL ATTYYGENIK LVGSTAAFGS WSPSAGILLS 551                                                 600
CL00002146  ASSYTASNPL WTTTVSVPQG STVEFKFIRV GSDGSITWES GNNKVLTVGS
CL00004076  ASSYTASNPL WTTTVSVPQG STVEFKFIRV GSDGSITWES GNNKVLTVGS
CL00016472  ASSYTASNPL WTTTVSVPQG STVEFKFIRV GSDGSITWES GNNKVLTVGS
CL00020555  ASSYTASNPL WTTTVSVPQG STVEFKFIRV GSDGSITWES GNNKVLTVGS
CL00023829  ASSYTASNPL WTTTVSVPQG STVEFKFIRV GSDGSITWES GNNKVLTVGS
CL00025225  ASSYTASNPL WTTTVSVPQG STVEFKFIRV GSDGSITWES GNNKVLTVGS 601        620
CL00002146  SATSVTVSAS WNGAYSVSSS
CL00004076  SATSVTVSAS WNGAYSVSSS
CL00016472  SATSVTVSAS WNGAYSVSSS
CL00020555  SATSVTVSAS WNGAYSVSSS
CL00023829  SATSVTVSAS WNGAYSVSSS
CL00025225  SATSVTVSAS WNGAYSVSSS
```

Fig. 9A

| Position (mature numbering) | Wild type residue | Particular variants |
|---|---|---|
| 14 | S | Q |
| 23 | K | N, R, Y |
| 30 | S | D, N, P |
| 31 | T | E, K, N, Q |
| 35 | A | L |
| 36 | S | R |
| 39 | S | A |
| 44 | L | I |
| 49 | T | K, R |
| 50 | S | E, I, N, Y |
| 51 | N | D |
| 53 | D | N |
| 69 | I | L, M |
| 83 | E | K |
| 98 | T | S |
| 111 | A | G |
| 117 | A | P, V |
| 118 | D | N |
| 119 | L | M |
| 121 | Q | A, P |
| 147 | Y | W |
| 157 | C | W |
| 179 | Y | F |
| 186 | P | Y |
| 197 | Y | H |
| 250 | S | D, E, K |
| 262 | A | S |
| 284 | Q | H |
| 286 | I | A |
| 287 | T | N |
| 288 | T | H |
| 300 | A | L, Q |
| 309 | T | D, E, Q |
| 311 | L | V |
| 317 | A | K |
| 347 | L | K |
| 362 | T | A |
| 385 | S | L, Q |
| 388 | T | I, K, Y |
| 400 | T | K |
| 413 | N | S |
| 415 | A | D, F, N, S, T, W, Y |
| 419 | Q | P |

Fig. 9B

| Position (mature numbering) | Wild type residue | Particular variants |
|---|---|---|
| 423 | Q | M, P |
| 434 | S | T |
| 457 | G | N, P |
| 463 | T | F |
| 516 | F | L |
| 526 | L | F |
| 530 | S | E, G |
| 533 | T | K |
| 534 | A | L |
| 535 | S | E, G, K, T |
| 540 | T | A, S |
| 545 | V | L |
| 547 | Q | A, H |
| 553 | F | Y |
| 555 | F | Y |
| 564 | I | F |
| 572 | K | E |
| 576 | V | I, L |
| 577 | G | R |
| 581 | T | I, K |
| 583 | V | F |
| 585 | V | P |
| 588 | S | Q |

CL00002146 G16 TpGlucoamylase G1P amino acid sequence SEQ ID NO:1

SPVSKRATLDEFISTERPLALEKLLCNIGSTGCRASGASSGVVLASPSTSNPDYYYTWTRDAALVFKEIVDS
VETNTTLLLPEIENYVTAQAYLQTVTNPSGSLSDGAGLAEPKFNADLTQFTGAWGRPQRDGPALRATAMIAY
YNYLLNNNATTDCGLWQIIQNDLNYVAQYWNQTGYDLWEEVPGSSFFTVAAQYRALVEGSTLAAKLGKSHSA
YDTVAPQILCYLQSFWSSSKGYIVANTQTASWVSRSGLDANTPLTAIHLFDPELGCDDSTFQPCSPKQLITT
KKLVDSFRSIYAINSGKSAGTALAVGRYAEDVYYNGNPWYLCTLAVAEQLYDAVYTWKLEGSITVTSVSLPF
FTDLLPSLTTGTYASGSTTFESIISAVTTYADGFVSIVQTYTPSDGALSEQYNKANGQQLSAQDLTWSYAAF
LSATERRDSVVPAGWAGASSVSVPGACAATTVVGTYAAASNCGTPGSGSGGNGGSSGNALVTFNELATTYYG
ENIKLVGSTAAFGSWSPSAGILLSASSYTASNPLWTTTVSVPQGSTVEFKFIRVGSDGSITWESGNNKVLTV
GSSATSVTVSASWNGAYSVSSS

CL00002146 G16 TpGlucoamylase G1P nucleic acid sequence SEQ ID NO:2

TCGCCTGTTTCCAAGCGCGCTACGCTGGACGAGTTCATCAGCACCGAGCGTCCCTTGGCTCTGGAGAAGCTG
CTCTGCAACATTGGTTCCACTGGTTGCCGTGCTTCGGGAGCTTCTTCGGGAGTCGTTCTGGCCTCGCCGTCC
ACCAGCAACCCCGGACTACTACTACACTTGGACCCGTGATGCTGCTCTGGTCTTTAAGGAGATTGTCGACTCT
GTCGAGACTAACACCACTCTGCTGCTGCCAGAGATTGAGAACTACGTTACTGCCCAGGCTTACCTGCAGACC
GTGACGAACCCCTCGGGTTCGCTGTCGGATGGTGCTGGTCTGGCTGAGCCAAGTTCAACGCTGATTTGACT
CAGTTCACTGGTGCCTGGGGTCGTCCTCAGCGTGATGGTCCGGCTCTGCGTGCTACGGCTATGATCGCCTAC
TACAACTACCTGCTCAACAACAACGCCACTACCGACTGTGGTCTGTGGCAGATTATCCAGAACGACCTGAAT
TACGTCGCTCAGTACTGGAACCAAACTGGTTACGACCTGTGGGAGGAGGTTCCGGGTTCATCCTTTTTCACT
GTTGCTGCTCAGTACAGAGCTCTCGTTGAGGGTTCTACCCTTGCTGCCAAGCTCGGCAAGTCTCACTCGGCC
TACGACACTGTCGCTCCGCAGATTCTGTGCTACTTGCAGAGCTTCTGGTCATCCAGCAAGGGCTACATTGTC
GCCAACACCCAGACTGCCAGCTGGGTCTCGCGGTCCGGTCTTGATGCCAACACTCCCTTGACTGCCATCCAC
CTATTTGACCCTGAACTTGGCTGCGATGACTCGACTTTCCAGCCCTGCTCGCCCAAGCAGCTTATCACTACT
AAGAAGCTCGTTGACTCGTTCCGCTCCATCTATGCCATCAACTCGGGCAAGTCTGCTGGTACTGCTTTGGCT
GTTGGTCGTTACGCCGAGGACGTCTACTACAACGGCAACCCCTGGTACCTGTGCACTTTGGCTGTTGCTGAG
CAGCTTTACGATGCAGTTTACACTTGGAAGCTCGAGGGCTCCATCACCGTCACCTCTGTCTCGCTGCCCTTC
TTCACTGACCTGCTGCCCTCGCTGACCACTGGCACCTACGCTTCGGGCTCGACCACCTTCGAATCCATCATC
TCTGCTGTGACTACCTACGCTGATGGCTTTGTCAGTATTGTCCAGACCTACACTCCCTCTGACGGCGCTCTG
TCTGAGCAGTACAACAAGGCCAACGGCCAGCAGCTGTCGGCTCAGGACCTGACCTGGTCGTACGCCGCTTTC
CTATCTGCCACTGAGCGCCGTGACAGCGTTGTCCCTGCCGGCTGGGCTGGTGCCTCGTCTGTCTCTGTGCCC
GGCGCCTGCGCTGCTACCACCGTTGTCGGAACCTACGCTGCTGCCTCCAACTGCGGTACTCCTGGCTCTGCC
TCGGGCGGCAACGGTGGCTCGAGCGGTAACGCCCTGGTGACTTTCAACGAGCTGGCTACTACCTACTACGGC
GAGAACATTAAGCTTGTCGGCAGCACAGCTGCTTTCGGTTCGTGGTCGCCCTCAGCTGGTATTCTCCTGTCT
GCCTCGTCGTACACGGCCAGCAACCCTCTGTGGACTACCACCGTGTCGGTTCCCCAGGGCTCGACCGTTGAG
TTCAAGTTCATCCGTGTTGGCTCCGACGGCAGCATCACGTGGGAGAGCGGCAACAACAAGGTGTTGACGGTT
GGCTCTTCGGCCACGAGCGTCACTGTTTCTGCCAGCTGGAACGGCGCCTACTCGGTGTCTAGCTCT

CL00004076 G16 TpGlucoamylase G2P amino acid sequence SEQ ID NO:3

SPVSKRATLDEFISTERPLALEKLLCNIGSTGCRASGASSGVVLASPSTSNPDYYYTWTRDAALVFKEIVDS
VETNTTLLLPEIENYVTAQAYLQTVTNPSGSLSDGAGLGEPKFNADLTQFTGAWGRPQRDGPALRATAMIAY
YNYLLNNNATTDCGLWQIIQNDLNYVAQYWNQTGYDLWEEVPGSSFFTVAAQYRALVEGSTLAAKLGKSHSA
YDTVAPQILCYLQSFWSSSKGYIVANTQTASWVSRSGLDANTPLTAIHLFDPELGCDDSTFQPCSPKQLITT
KKLVDSFRSIYAINSGKSAGTALAVGRYAEDVYYNGNPWYLCTLAVAEQLYDAVYTWKLEGSITVTSVSLPF
FTDLLPSLTTGTYASGSTTFESIISAVTTYADGFVSIVQTYTPSDGALSEQYNKANGQQLSAQDLTWSYAAF

Fig. 10B

LSATERRRDSVVPAGWAGASSVSVPGACAATTVVGTYAAASNCGTPGSGSGGNGGSSGNALVTFNELATTYYG
ENIKLVGSTAAFGSWSPSAGILLSASSYTASNPLWTTTVSVPQGSTVEFKFIRVGSDGSITWESGNNKVLTV
GSSATSVTVSASWNGAYSVSSS

CL00004076 G16 TpGlucoamylase G2P nucleic acid sequence SEQ ID NO:4

```
TCGCCTGTTTCCAAGCGCGCTACGCTGGACGAGTTCATCAGCACCGAGCGTCCCTTGGCTCTGGAGAAGCTG
CTCTGCAACATTGGTTCCACTGGTTGCCGTGCTTCGGGAGCTTCTTCGGGAGTCGTTCTGGCCTCGCCGTCC
ACCAGCAACCCGGACTACTACTACACTTGGACCCGTGATGCTGCTCTGGTCTTTAAGGAGATTGTCGACTCT
GTCGAGACTAACACCACTCTGCTGCTGCCAGAGATTGAGAACTACGTTACTGCCCAGGCTTACCTGCAGACC
GTGACGAACCCCTCGGGTTCGCTGTCGGATGGTGCTGGTCTGGGCGAGCCCAAGTTCAACGCTGATTTGACT
CAGTTCACTGGTGCCTGGGGTCGTCCTCAGCGTGATGGTCCGGCTCTGCGTGCTACGGCTATGATCGCCTAC
TACAACTACCTGCTCAACAACAACGCCACTACCGACTGTGGTCTGTGGCAGATTATCCAGAACGACCTGAAT
TACGTCGCTCAGTACTGGAACCAAACTGGTTACGACCTGTGGGAGGAGGTTCCGGGTTCATCCTTTTTCACT
GTTGCTGCTCAGTACAGAGCTCTCGTTGAGGGTTCTACCCTTGCTGCCAAGCTCGGCAAGTCTCACTCGGCC
TACGACACTGTCGCTCCGCAGATTCTGTGCTACTTGCAGAGCTTCTGGTCATCCAGCAAGGGCTACATTGTC
GCCAACACCCAGACTGCCAGCTGGGTCTCGCGGTCCGGTCTTGATGCCAACACTCCCTTGACTGCCATCCAC
CTATTTGACCCTGAACTTGGCTGCGATGACTCGACTTTCCAGCCCTGCTCGCCCAAGCAGCTTATCACTACT
AAGAAGCTCGTTGACTCGTTCCGCTCCATCTATGCCATCAACTCGGGCAAGTCTGCTGGTACTGCTTTGGCT
GTTGGTCGTTACGCCGAGGACGTCTACTACAACGGCAACCCCTGGTACCTGTGCACTTTGGCTGTTGCTGAG
CAGCTTTACGATGCAGTTTACACTTGGAAGCTCGAGGGCTCCATCACCGTCACCTCTGTCTCGCTGCCCTTC
TTCACTGACCTGCTGCCCTCGCTGACCACTGGCACCTACGCTTCGGGCTCGACCACCTTCGAATCCATCATC
TCTGCTGTGACTACCTACGCTGATGGCTTTGTCAGTATTGTCCAGACCTACACTCCCTCTGACGGCGCTCTG
TCTGAGCAGTACAACAAGGCCAACGGCCAGCAGCTGTCGGCTCAGGACCTGACCTGGTCGTACGCCGCTTTC
CTATCTGCCACTGAGCGCCGTGACAGCGTTGTCCCTGCCGGCTGGGCTGGTGCCTCGTCTGTCTCTGTGCCC
GGCGCCTGCGCTGCTACCACCGTTGTCGGAACCTACGCTGCTGCCTCCAACTGCGGTACTCCTGGCTCTGGC
TCGGGCGGCAACGGTGGCTCGAGCGGTAACGCCCTGGTGACTTTCAACGAGCTGGCTACTACCTACTACGGC
GAGAACATTAAGCTTGTCGGCAGCACAGCTGCTTTCGGTTCGTGGTCGCCCTCAGCTGGTATTCTCCTGTCT
GCCTCGTCGTACACGGCCAGCAACCCTCTGTGGACTACCACCGTGTCGGTTCCCCAGGGCTCGACCGTTGAG
TTCAAGTTCATCCGTGTTGGCTCCGACGGCAGCATCACGTGGGAGAGCGGCAACAACAAGGTGTTGACGGTT
GGCTCTTCGGCCACGAGCGTCACTGTTTCTGCCAGCTGGAACGGCGCCTACTCGGTGTCTAGCTCT
```

CL00016472 G16 TpGlucoamylase G3P amino acid sequence SEQ ID NO:5

SPVSKRATLDEFISTERPLALEKLLCNIGPTGCRASGASSGVVLASPSTSNPDYYYTWTRDAALVFKEIVDS
VETNTTLLLPEIENYVTAQAYLQTVTNPSGSLSDGAGLGEPKFNADLTQFTGAWGRPQRDGPALRATAMIAY
YNYLLNNNATTDCGLWQIIQNDLNYVAQYWNQTGYDLWEEVPGSSFFTVAAQYRALVEGSTLAAKLGKSHSA
YDTVAPQILCYLQSFWSSSKGYIVANTQTASWVSRSGLDANTPLTAIHLFDPELGCDDSTFQPCSPKQLITT
KKLVDSFRSIYAINSGKSAGTALAVGRYAEDVYYNGNPWYLCTLAVAEQLYDAVYTWKLEGSITVTSVSLPF
FTDLLPSLTTGTYASGSTTFESIISAVTTYADGFVSIVQTYTPSDGALSEQYNKANGQQLSAQDLTWSYAAF
LSATERRRDSVVPAGWAGASSVSVPGACAATTVVGTYAAASNCGTPGSGSGGNGGSSGNALVTFNELATTYYG
ENIKLVGSTAAFGSWSPSAGILLSASSYTASNPLWTTTVSVPQGSTVEFKFIRVGSDGSITWESGNNKVLTV
GSSATSVTVSASWNGAYSVSSS

CL00016472 G16 TpGlucoamylase G3P nucleic acid sequence SEQ ID NO:6

```
TCGCCTGTTTCCAAGCGCGCTACGCTGGACGAGTTCATCAGCACCGAGCGTCCCTTGGCTCTGGAGAAGCTG
CTCTGCAACATTGGTCCTACTGGTTGCCGTGCTTCGGGAGCTTCTTCGGGAGTCGTTCTGGCCTCGCCGTCC
ACCAGCAACCCGGACTACTACTACACTTGGACCCGTGATGCTGCTCTGGTCTTTAAGGAGATTGTCGACTCT
GTCGAGACTAACACCACTCTGCTGCTGCCAGAGATTGAGAACTACGTTACTGCCCAGGCTTACCTGCAGACC
```

Fig. 10C

```
GTGACGAACCCCTCGGGTTCGCTGTCGGATGGTGCTGGTCGGGCGAGCCCAAGTTCAACGCTGATTTGACT
CAGTTCACTGGTGCCTGGGGTCGTCCTCAGCGTGATGGTCCGGCTCTGCGTGCTACGGCTATGATCGCCTAC
TACAACTACCTGCTCAACAACAACGCCACTACCGACTGTGGTCTGTGGCAGATTATCCAGAACGACCTGAAT
TACGTCGCTCAGTACTGGAACCAAACTGGTTACGACCTGTGGGAGGAGGTTCCGGGTTCATCCTTTTTCACT
GTTGCTGCTCAGTACAGAGCTCTCGTTGAGGGTTCTACCCTTGCTGCCAAGCTCGGCAAGTCTCACTCGGCC
TACGACACTGTCGCTCCGCAGATTCTGTGCTACTTGCAGAGCTTCTGGTCATCCAGCAAGGGCTACATTGTC
GCCAACACCCAGACTGCCAGCTGGGTCTCGCGGTCCGGTCTTGATGCCAACACTCCCTTGACTGCCATCCAC
CTATTTGACCCTGAACTTGGCTGCGATGACTCGACTTTCCAGCCCTGCTCGCCCAAGCAGCTTATCACTACT
AAGAAGCTCGTTGACTCGTTCCGCTCCATCTATGCCATCAACTCGGGCAAGTCTGCTGGTACTGCTTTGGCT
GTTGGTCGTTACGCCGAGGACGTCTACTACAACGGCAACCCCTGGTACCTGTGCACTTTGGCTGTTGCTGAG
CAGCTTTACGATGCAGTTTACACTTGGAAGCTCGAGGGCTCCATCACCGTCACCTCTGTCTCGCTGCCCTTC
TTCACTGACCTGCTGCCCTCGCTGACCACTGGCACCTACGCTTCGGGCTCGACCACCTTCGAATCCATCATC
TCTGCTGTGACTACCTACGCTGATGGCTTTGTCAGTATTGTCCAGACCTACACTCCCTCTGACGGCGCTCTG
TCTGAGCAGTACAACAAGGCCAACGGCCAGCAGCTGTCGGCTCAGGACCTGACCTGGTCGTACGCCGCTTTC
CTATCTGCCACTGAGCGCCGTGACAGCGTTGTCCCTGCCGGCTGGGCTGGTGCCTCGTCTGTCTCTGTGCCC
GGCGCCTGCGCTGCTACCACCGTTGTCGGAACCTACGCTGCTGCCTCCAACTGCGGTACTCCTGGCTCTGGC
TCGGGCGGCAACGGTGGCTCGAGCGGTAACGCCCTGGTGACTTTCAACGAGCTGGCTACTACCTACTACGGC
GAGAACATTAAGCTTGTCGGCAGCACAGCTGCTTTCGGTTCGTGGTCGCCCTCAGCTGGTATTCTCCTGTCT
GCCTCGTCGTACACGGCCAGCAACCCTCTGTGGACTACCACCGTGTCGGTTCCCCAGGGCTCGACCGTTGAG
TTCAAGTTCATCCGTGTTGGCTCCGACGGCAGCATCACGTGGGAGAGCGGCAACAACAAGGTGTTGACGGTT
GGCTCTTCGGCCACGAGCGTCACTGTTTCTGCCAGCTGGAACGGCGCCTACTCGGTGTCTAGCTCT
```

CL00020555 G16 TpGlucoamylase G4P amino acid sequence SEQ ID NO:207

```
SPVSKRATLDEFISTERPLALERLLCNIGPTGCRASGAASGVVLASPSKSNPDYYYTWTRDAALVFKEIVDS
VETNTTLLLPEIENYVTAQAYLQTVTNPSGSLSDGAGLGEPKFNADMTQFTGAWGRPQRDGPALRATAMIAY
YNYLLNNNATTDCGLWQIIQNDLNYVAQYWNQTGYDLWEEVPGSSFFTVAAQYRALVEGSTLAAKLGKSHSA
YDTVAPQILCYLQSFWSSSKGYIVANTQTASWVSRSGLDANTPLTAIHLFDPELGCDDSTFQPCSPKQLITT
KKLVDSFRSIYAINSGKSAGTALAVGRYAEDVYYNGNPWYLCTLAVAEQLYDAVYTWKLEGSITVTSVSLPF
FTDLLPSLTTGTYASGSTTFESIISAVTTYADGFVSIVQTYTPSDGALSEQYNKANGQQLSAPDLTWSYAAF
LSATERRDSVVPAGWAGASSVSVPGACAATTVVGTYAAASNCGTPGSGSGGNGGSSGNALVTFNELATTYYG
ENIKLVGSTAAFGSWSPSAGILLSASSYTASNPLWTTTVSVPQGSTVEFKFIRVGSDGSITWESGNNKVLTV
GSSATSVTVSASWNGAYSVSSS
```

CL00020555 G16 TpGlucoamylase G4P nucleic acid sequence SEQ ID NO:208

```
TCGCCTGTTTCCAAGCGCGCTACGCTGGACGAGTTCATCAGCACCGAGCGTCCCTTGGCTCTGGAGCGCCTG
CTCTGCAACATTGGTCCTACTGGTTGCCGTGCTTCGGGAGCTGCCTCGGGAGTCGTTCTGGCCTCGCCGTCC
AAGAGCAACCCGGACTACTACTACACTTGGACCCGTGATGCTGCTCTGGTCTTTAAGGAGATTGTCGACTCT
GTCGAGACTAACACCACTCTGCTGCTGCCAGAGATTGAGAACTACGTTACTGCCCAGGCTTACCTGCAGACC
GTGACGAACCCCTCGGGTTCGCTGTCGGATGGTGCTGGTCTGGGCGAGCCCAAGTTCAACGCTGATATGACT
CAGTTCACTGGTGCCTGGGGTCGTCCTCAGCGTGATGGTCCGGCTCTGCGTGCTACGGCTATGATCGCCTAC
TACAACTACCTGCTCAACAACAACGCCACTACCGACTGTGGTCTGTGGCAGATTATCCAGAACGACCTGAAT
TACGTCGCTCAGTACTGGAACCAAACTGGTTACGACCTGTGGGAGGAGGTTCCGGGTTCATCCTTTTTCACT
GTTGCTGCTCAGTACAGAGCTCTCGTTGAGGGTTCTACCCTTGCTGCCAAGCTCGGCAAGTCTCACTCGGCC
TACGACACTGTCGCTCCGCAGATTCTGTGCTACTTGCAGAGCTTCTGGTCATCCAGCAAGGGCTACATTGTC
```

Fig. 10D

```
GCCAACACCCAGACTGCCAGCTGGGTCTCGCGGTCCGGTCTTGATGCCAACACTCCCTTGACTGCCATCCAC
CTATTTGACCCTGAACTTGGCTGCGATGACTCGACTTTCCAGCCCTGCTCGCCCAAGCAGCTTATCACTACT
AAGAAGCTCGTTGACTCGTTCCGCTCCATCTATGCCATCAACTCGGGCAAGTCTGCTGGTACTGCTTTGGCT
GTTGGTCGTTACGCCGAGGACGTCTACTACAACGGCAACCCCTGGTACCTGTGCACTTTGGCTGTTGCAGAG
CAGCTTTACGATGCAGTTTACACTTGGAAGCTCGAGGGCTCCATCACCGTCACCTCTGTCTCGCTGCCCTTC
TTCACTGACCTGCTGCCCTCGCTGACCACTGGCACCTACGCTTCGGGCTCGACCACCTTCGAATCCATCATC
TCTGCTGTGACTACCTACGCTGATGGCTTTGTCAGTATTGTCCAGACCTACACTCCCTCTGACGGCGCTCTG
TCTGAGCAGTACAACAAGGCCAACGGCCAGCAGCTGTCGGCTCCCGACCTGACCTGGTCGTACGCCGCTTTC
CTATCTGCCACTGAGCGCCGTGACAGCGTTGTCCCTGCCGGCTGGGCTGGTGCCTCGTCTGTCTCTGTGCCC
GGCGCCTGCGCTGCTACCACCGTTGTCGGAACCTACGCTGCTGCCTCCAACTGCGGTACTCCTGGCTCTGGC
TCGGGCGGCAACGGTGGCTCGAGCGGTAACGCCCTGGTGACTTTCAACGAGCTGGCTACTACCTACTACGGC
GAGAACATTAAGCTTGTCGGCAGCACAGCTGCTTTCGGTTCGTGGTCGCCCTCAGCTGGTATTCTCCTGTCT
GCCTCGTCGTACACGGCCAGCAACCCTCTGTGGACTACCACCGTGTCGGTTCCCCAGGGCTCGACCGTTGAG
TTCAAGTTCATCCGTGTTGGCTCCGACGGCAGCATCACGTGGGAGAGCGGCAACAACAAGGTGTTGACGGTT
GGCTCTTCGGCCACGAGCGTCACTGTTTCTGCCAGCTGGAACGGCGCCTACTCGGTGTCTAGCTCT
```

CL00023829 G16 TpGlucoamylase G5P amino acid sequence SEQ ID NO:307

```
SPVSKRATLDEFISTERPLALERLLCNIGPTGCRASGAASGVVIASPSRSDPDYYYTWTRDAALVFKEIVDS
VETNTTLLLPEIENYVTAQAYLQTVTNPSGSLSDGAGLGEPKFNVDMTQFTGAWGRPQRDGPALRATAMIAY
YNYLLNNNATTDCGLWQIIQNDLNYVAQYWNQTGYDLWEEVPGSSFFTVAAQYRALVEGSTLAAKLGKSHSA
YDTVAPQILCYLQSFWSSSKGYIVANTQTASWVSRSGLDANTPLTAIHLFDPELGCDDSTFQPCSPKQLITT
KKLVDSFRSIYAINSGKSAGTALAVGRYAEDVYYNGNPWYLCTLAVAEQLYDAVYTWKLEGSITVTSVSLPF
FTDLLPSLTTGTYASGSTTFESIISAVTTYADGFVSIVQTYTPSDGALSEQYSKANGQQLSAPDLTWSYAAF
LSATERRDSVVPAGWAGASSVSVPGACAATTVVGTYAAASNCGTPGSGSGGNGGSSGNALVTFNELATTYYG
ENIKLVGSTAAFGSWSPSAGILLSASSYTASNPLWTTTVSVPQGSTVEFKFIRVGSDGSITWESGNNKVLTV
GSSATSVTVSASWNGAYSVSSS
```

CL00023829 G16 TpGlucoamylase G5P nucleic acid sequence SEQ ID NO:308

```
TCGCCTGTTTCCAAGCGCGCTACGCTGGACGAGTTCATCAGCACCGAGCGTCCCTTGGCTCTGGAGCGCCTG
CTCTGCAACATTGGTCCTACTGGTTGCCGTGCTTCGGGAGCTGCCTCGGGAGTCGTTATCGCCTCGCCGTCC
CGCAGCGATCCGGACTACTACTACACTTGGACCCGTGATGCTGCTCTGGTCTTTAAGGAGATTGTCGACTCT
GTCGAGACTAACACCACTCTGCTGCTGCCAGAGATTGAGAACTACGTTACTGCCCAGGCTTACCTGCAGACC
GTGACGAACCCCTCGGGTTCGCTGTCGGATGGTGCTGGTCTGGGCGAGCCCAAGTTCAACGTCGATATGACT
CAGTTCACTGGTGCCTGGGGTCGTCCTCAGCGTGATGGTCCGGCTCTGCGTGCTACGGCTATGATCGCCTAC
TACAACTACCTGCTCAACAACAACGCCACTACCGACTGTGGTCTGTGGCAGATTATCCAGAACGACCTGAAT
TACGTCGCTCAGTACTGGAACCAAACTGGTTACGACCTGTGGGAGGAGGTTCCGGGTTCATCCTTTTTCACT
GTTGCTGCTCAGTACAGAGCTCTCGTTGAGGGTTCTACCCTTGCTGCCAAGCTCGGCAAGTCTCACTCGGCC
TACGACACTGTCGCTCCGCAGATTCTGTGCTACTTGCAGAGCTTCTGGTCATCCAGCAAGGGCTACATTGTC
GCCAACACCCAGACTGCCAGCTGGGTCTCGCGGTCCGGTCTTGATGCCAACACTCCCTTGACTGCCATCCAC
CTATTTGACCCTGAACTTGGCTGCGATGACTCGACTTTCCAGCCCTGCTCGCCCAAGCAGCTTATCACTACT
AAGAAGCTCGTTGACTCGTTCCGCTCCATCTATGCCATCAACTCGGGCAAGTCTGCTGGTACTGCTTTGGCT
GTTGGTCGTTACGCCGAGGACGTCTACTACAACGGCAACCCCTGGTACCTGTGCACTTTGGCTGTTGCAGAG
CAGCTTTACGATGCAGTTTACACTTGGAAGCTCGAGGGCTCCATCACCGTCACCTCTGTCTCGCTGCCCTTC
TTCACTGACCTGCTGCCCTCGCTGACCACTGGCACCTACGCTTCGGGCTCGACCACCTTCGAATCCATCATC
```

Fig. 10E

```
TCTGCTGTGACTACCTACGCTGATGGCTTTGTCAGTATTGTCCAGACCTACACTCCCTCTGACGGCGCTCTG
TCTGAGCAGTACTCCAAGGCCAACGGCCAGCAGCTGTCGGCTCCCGACCTGACCTGGTCGTACGCCGCTTTC
CTATCTGCCACTGAGCGCCGTGACAGCGTTGTCCCTGCCGGCTGGGCTGGTGCCTCGTCTGTCTCTGTGCCC
GGCGCCTGCGCTGCTACCACCGTTGTCGGAACCTACGCTGCTGCCTCCAACTGCGGTACTCCTGGCTCTGGC
TCGGGCGGCAACGGTGGCTCGAGCGGTAACGCCCTGGTGACTTTCAACGAGCTGGCTACTACCTACTACGGC
GAGAACATTAAGCTTGTCGGCAGCACAGCTGCTTTCGGTTCGTGGTCGCCCTCAGCTGGTATTCTCCTGTCT
GCCTCGTCGTACACGGCCAGCAACCCTCTGTGGACTACCACCGTGTCGGTTCCCCAGGGCTCGACCGTTGAG
TTCAAGTTCATCCGTGTTGGCTCCGACGGCAGCATCACGTGGGAGAGCGGCAACAACAAGGTGTTGACGGTT
GGCTCTTCGGCCACGAGCGTCACTGTTTCTGCCAGCTGGAACGGCGCCTACTCGGTGTCTAGCTCT
```

CL00025225 G16 TpGlucoamylase G6P amino acid sequence SEQ ID NO:361

```
SPVSKRATLDEFISTERPLALERLLCNIGPTGCRASGAASGVVIASPSRSDPDYYYTWTRDAALVFKEIVDS
VETNTTLLLPEIENYVTAQAYLQTVTNPSGSLSDGAGLGEPKFNVDMTPFTGAWGRPQRDGPALRATAMIAY
YNYLLNNNATTDCGLWQIIQNDLNYVAQYWNQTGYDLWEEVPGSSFFTVAAQYRALVEGSTLAAKLGKSHSA
YDTVAPQILCYLQSFWSSSKGYIVANTQTASWVSRSGLDANTPLTAIHLFDPELGCDDSTFQPCSPKQLITT
KKLVDSFRSIYAINSGKSAGDALAVGRYAEDVYYNGNPWYLCTLAVAEQLYDAVYTWKLEGSITVTSVSLPF
FTDLLPSLTTGTYASGSTTFESIISAVTTYADGFVSIVQTYTPSDGALSEQYSKYNGQQLSAPDLTWSYAAF
LSATERRDSVVPAGWAGASSVSVPGACAATTVVGTYAAASNCGTPGSGSGGNGGSSGNALVTFNELATTYYG
ENIKLVGSTAAFGSWSPSAGILLSASSYTASNPLWTTTVSVPQGSTVEFKFIRVGSDGSITWESGNNKVLTV
GSSATSVTVSASWNGAYSVSSS
```

CL00025225 G16 TpGlucoamylase G6P nucleic acid sequence SEQ ID NO:362

```
TCGCCTGTTTCCAAGCGCGCTACGCTGGACGAGTTCATCAGCACCGAGCGTCCCTTGGCTCTGGAGCGCCTG
CTCTGCAACATTGGTCCTACTGGTTGCCGTGCTTCGGGAGCTGCCTCGGGAGTCGTTATCGCCTCGCCGTCC
CGCAGCGATCCGGACTACTACTACACTTGGACCCGTGATGCTGCTCTGGTCTTTAAGGAGATTGTCGACTCT
GTCGAGACTAACACCACTCTGCTGCTGCCAGAGATTGAGAACTACGTTACTGCCCAGGCTTACCTGCAGACC
GTGACGAACCCCTCGGGTTCGCTGTCGGATGGTGCTGGTCTGGGCGAGCCCAAGTTCAACGTCGATATGACT
CCCTTCACTGGTGCCTGGGGTCGTCCTCAGCGTGATGGTCCGGCTCTGCGTGCTACGGCTATGATCGCCTAC
TACAACTACCTGCTCAACAACAACGCCACTACCGACTGTGGTCTGTGGCAGATTATCCAGAACGACCTGAAT
TACGTCGCTCAGTACTGGAACCAAACTGGTTACGACCTGTGGGAGGAGGTTCCGGGTTCATCCTTTTTCACT
GTTGCTGCTCAGTACAGAGCTCTCGTTGAGGGTTCTACCCTTGCTGCCAAGCTCGGCAAGTCTCACTCGGCC
TACGACACTGTCGCTCCGCAGATTCTGTGCTACTTGCAGAGCTTCTGGTCATCCAGCAAGGGCTACATTGTC
GCCAACACCCAGACTGCCAGCTGGGTCTCGCGGTCCGGTCTTGATGCCAACACTCCCTTGACTGCCATCCAC
CTATTTGACCCTGAACTTGGCTGCGATGACTCGACTTTCCAGCCCTGCTCGCCCAAGCAGCTTATCACTACT
AAGAAGCTCGTTGACTCGTTCCGCTCCATCTATGCCATCAACTCGGGCAAGTCTGCTGGTGATGCTTTGGCT
GTTGGTCGTTACGCCGAGGACGTCTACTACAACGGCAACCCCTGGTACCTGTGCACTTTGGCTGTTGCAGAG
CAGCTTTACGATGCAGTTTACACTTGGAAGCTCGAGGGCTCCATCACCGTCACCTCTGTCTCGCTGCCCTTC
TTCACTGACCTGCTGCCCTCGCTGACCACTGGCACCTACGCTTCGGGCTCGACCACCTTCGAATCCATCATC
TCTGCTGTGACTACCTACGCTGATGGCTTTGTCAGTATTGTCCAGACCTACACTCCCTCTGACGGCGCTCTG
TCTGAGCAGTACTCCAAGTACAACGGCCAGCAGCTGTCGGCTCCCGACCTGACCTGGTCGTACGCCGCTTTC
CTATCTGCCACTGAGCGCCGTGACAGCGTTGTCCCTGCCGGCTGGGCTGGTGCCTCGTCTGTCTCTGTGCCC
GGCGCCTGCGCTGCTACCACCGTTGTCGGAACCTACGCTGCTGCCTCCAACTGCGGTACTCCTGGCTCTGGC
TCGGGCGGCAACGGTGGCTCGAGCGGTAACGCCCTGGTGACTTTCAACGAGCTGGCTACTACCTACTACGGC
GAGAACATTAAGCTTGTCGGCAGCACAGCTGCTTTCGGTTCGTGGTCGCCCTCAGCTGGTATTCTCCTGTCT
```

Fig. 10F

```
GCCTCGTCGTACACGGCCAGCAACCCTCTGTGGACTACCACCGTGTCGGTTCCCCAGGGCTCGACCGTTGAG
TTCAAGTTCATCCGTGTTGGCTCCGACGGCAGCATCACGTGGGAGAGCGGCAACAACAAGGTGTTGACGGTT
GGCTCTTCGGCCACGAGCGTCACTGTTTCTGCCAGCTGGAACGGCGCCTACTCGGTGTCTAGCTCT
```

Upstream genomic sequence of Thielaviopsis punctuala SEQ ID NO:363

>G16G1P-Promoter

```
TTTTTTTTTTTTTTTTTTTTTTTTCATCATCTCTTGTGTTTGTTCTCGGTATTATACGCCTGAATCCGCCT
ACGACCCGAGAAGTATGTGGCGAGGCAGGATTTACTTACTTCTCTGCATTCATGTCGCTTTTTCTGTCACCT
GTATTCATCTTTGGATCACCTCATCAAACCCTCATTTGCTCTCGAGTCATGTGTTTCCTTCTCTTGCAAAGC
CCGCTCTTGAGGTATATCTAATCTCTCTCGGCTTCATTTCCAGCAGAAAATGGCCGAGAGAAACAACACTGG
ACCTGAGGGGCAGAATAAAGTGAGACTGTGTGATGAGGTGATGGGGCTCTCCAACTTCAAGTCTCAAAGGGG
TATATCAGCATTGGATGGAGAACTAGATGTCTATTAAAAGCAAAAGGGCGTTTGGGCTGCAACTGGTTCAAG
GCTTTCACGATGGATGAGGAAGGAAACCTCGAGATGTGATGTTTTGGCCTGTCATTCGTAGGCAAACTCCAG
GTTTATACTAACTTCCGTTAGACCATTATAATTACATACAAAGCTAGCGCCAGGGTGTCTACAGCAACACAC
CCCTACCTCATTTTAACCTTTCTTAATCCCGTCTTTATTTCTCTTCCTACGTGTTAAGGATTTTGTTTAACG
CATACACGCCATGGATATGAATAAGGAAAAACGTTTTCTCAAAGAGATTACCAGCTTTGATGTTGAGCATCA
GAGGCGAGCTCGGACTCGGAAGACGCCGGGGCGTCTGGTGTGGTAAGTGTTCATTTTCTTGACATGATTCTG
TGAACGCCTAGGCAAGTCTGTCTGTTGCCTGATCTAGCGACTCGGGAGTCTAGAGTGAGATGAGCTGATGTG
AGGTCAGTGTATATATGTATATGCAAAACCAGGTCCAAGTTCCGTTGGTTGTGTTGCAGTTGCATTCTCGAC
CTGGAGAACTGGAACCGGTTTTCGGGCCGTTTATTTCATCTCTCTTTTATTGACGCGAACATCTCTATTCAC
CCGGACATCATAAATACCACGTCCTTTTTGGTTCAAGTCACAAGCCAAAGGAGAAGAAGAGAAAGAATAACC
CGAGGAAAATAAACAGCCGTCACAAATTCGGGGCAGTCGTGTGGGGAAAGAACCAAATATGGGGTTGCGAGT
ATTATGTAATACAGACGACAAGGGGTTAAAAAAGAGGAAGGAACTTGCCCCGGATGCTGCACTCTTCTCGGG
CGTCATTACCATTCTTGTCTTTTTGTTTTTCATGCTCCATGCTGGCATGTGATTGTGGCCTCTTCTCCTCCT
TGTTTTCGTCTTTCATGTCGGTCTTTGATCATCGTCTCTATCACCTTCTCTCATCTTCTCTCTTTCTTTCTC
TTCCTTTCTCCTGGCAGCCTTATATCCTTCGTCTTCGAAAAGTCCATAGCCGCTATCTATGTATACACCAGC
CCCATCCTTTCTGTCGAGTCTGGCTCTCTCCAACGCGGCTCTAGCACTACCCCTTGCCATGCTCTTTCTTCA
TCAAATAAGAAAACAAAAACGCATCTGGTTCCTCTTGTCTCGTCACATACCGCCGCACTTTCCTTCCCGGGC
ATAGCTGAGCCTTGGTCCAGTCGGCCCTTTCCTGAATCCATGACTTCATGTCGCCCTTTTTGGAGGTTGTAT
CGTGGAGGTTGAGTTTAGCCTGCCATTCATTGCAATACCGTCTTGCTCACTATTGCAAACATGCTGCAATAT
AGACTCGGACTCTCTTAGATCGTGTCACTCGGTCTTGAAATCCATCACGATATTGTTGACTGACCATTTCTA
TATCTAGGGCCTTTGTCTGCCTCTCCTTCGTTTCCTTCTCCCTCTCTCTTCTCTCCACCAAGCAAAGCTTCT
CTTCGTCTTCTCTAGACACTTCCAGCTTGTCTGCCTGCTCCTCTTCCTCTGCTCTTGTCTGCTTGCTTTCTG
CGCCTGCTACTGCAATA
```

… # 2G16 GLUCOAMYLASE COMPOSITIONS AND METHODS

CROSS REFERENCE TO RELATED APPLICATIONS

This application claims priority under 35 U.S.C. §120 as a continuation-in-part of U.S. patent application Ser. No. 15/230,292, filed on Aug. 5, 2016, which is expressly incorporated by reference in its entirety.

SEQUENCE LISTING

The instant application contains a Sequence Listing which has been submitted electronically in ASCII format and is hereby incorporated by reference in its entirety. Said ASCII copy, created on Dec. 5, 2016, is named 5004_ST25.txt and is 1,374 kilobytes in size.

FIELD OF THE INVENTION

This invention relates to variant glucoamylases, polynucleotides encoding the variant glucoamylases, methods of producing the variant glucoamylases, and methods of using the variant glucoamylases. Also described are the use of glucoamylases of the invention for varying from starch conversion to produce fermentation products, such as ethanol, and syrups, such as glucose, as well as animal feedstocks. The invention also relates to compositions comprising one or more variant glucoamylases of the invention.

BACKGROUND OF THE INVENTION

Glucoamylase (1,4-alpha-D-glucan glucohydrolase, EC 3.2.1.3) is an enzyme, which catalyzes the release of D-glucose from the non-reducing ends of starch or related oligosaccharide and polysaccharide molecules. Glucoamylases are produced by several filamentous fungi and yeast, with those from *Aspergillus* being generally most important for commercial purposes.

Commercially, glucoamylases are used to convert starch containing material, which is already partially hydrolyzed by an alpha-amylase, to glucose. The glucose may then be converted directly or indirectly into a fermentation product using a fermenting organism. Examples of commercial fermentation products include alcohols (e.g., ethanol, methanol, butanol, 1,3-propanediol); organic acids (e.g., citric acid, acetic acid, itaconic acid, lactic acid, gluconic acid, gluconate, lactic acid, succinic acid, 2,5-diketo-D-gluconic acid); ketones (e.g., acetone); amino acids (e.g., glutamic acid); gases (e.g., $H_2$ and $CO_2$), and more complex compounds, including, for example, antibiotics (e.g., penicillin and tetracycline); enzymes; vitamins (e.g., riboflavin, $B_{12}$, beta-carotene); hormones, and other compounds which are difficult to produce synthetically. Fermentation processes are also commonly used in the consumable alcohol (e.g., beer and wine), dairy (e.g., in the production of yogurt and cheese) industries.

The end product may also be syrup. For instance, the end product may be glucose, but may also be converted, e.g., by glucose isomerase to fructose or a mixture composed almost equally of glucose and fructose. This mixture, or a mixture further enriched with fructose, is the most commonly used high fructose corn syrup (HFCS) commercialized throughout the world.

The end product may also be a commercial feedstock, fed to agricultural animals. Furthermore, glucoamylase has significant applications in food, textile and pharmaceutical industries. In the food industry for an example, glucoamylase is used to improve bread crust color and produce low-calorie beer. Another key application of glucoamylase is as a digestive aid when used together with a cocktail of other enzymes.

However, there remains a need in the art for variant glucoamylases with increased activity, thermoactivity, thermostability and pH stability. The present invention meets this need and provides variant glucoamylases with improved properties compared to a parent glucoamylase.

It is an object of the present invention to provide variant glucoamylase enzymes having glucoamylase activity and polynucleotides encoding the variant glucoamylase enzymes and methods of using the variant glucoamylase enzymes in various processes.

BRIEF SUMMARY OF THE INVENTION

Accordingly, the present invention provides isolated wild-type glucoamylases as well as variant glucoamylases and methods of using them.

In one aspect, the invention provides nucleic acid constructs comprising a nucleic acid encoding SEQ ID NO:1 operably linked to an exogenous construct sequence, such as an exogenous promoter and/or a selection gene.

In another aspect, the nucleic acid construct comprising a nucleic acid encoding SEQ ID NO:1 is an extrachromasomal expression vector, and can comprise an origin of replication and/or a selection gene.

In a further aspect, the nucleic acid construct is an integrating expression vector.

In an additional aspect, the invention provides a host cell comprising a nucleic acid encoding SEQ ID NO:1, wherein the host cell is not a *Thielaviopsis punctuala* cell. The host cell can also comprise an exogenous promoter operably linked to the nucleic acid encoding SEQ ID NO:1, and a selection gene.

In a further aspect the invention provides methods of making a host cell comprising transforming the cell with a nucleic acid construct such that the host cell expresses SEQ ID NO:1. The nucleic acid construct can be an extrachromosomal expression vector, such that the glucoamylase is produced, which can be optionally recovered from the cell media.

In an additional aspect, the invention provides methods of carbohydrate saccharification from a starch substrate comprising contacting the substrate with a glucoamylase enzyme of SEQ ID NO:1, wherein the starch is degraded.

In additional aspects, the invention provides compositions comprising variant glucoamylase enzymes comprising at least one amino acid substitutions as compared to SEQ ID NO:1, wherein the amino acid substitution is at a position number selected from the group consisting of: 14, 23, 30, 31, 35, 36, 39, 44, 49, 50, 51, 53, 69, 83, 98, 111, 117, 118, 119, 121, 147, 157, 179, 186, 197, 250, 262, 284, 286, 287, 288, 300, 309, 311, 317, 347, 362, 385, 388, 400, 413, 415, 419, 423, 434, 457, 463, 516, 526, 530, 533, 534, 535, 540, 545, 547, 553, 555, 564, 572, 576, 577, 581, 583, 585 and 588. In some embodiments of this aspect, the variant enzyme is at least 95%, 96%, 97%, 98%, 99% or 100% identical to one or more of SEQ ID NO:1, SEQ ID NO:3, SEQ ID NO:5, SEQ ID NO:207, SEQ ID NO:307 and SEQ ID NO:361. In some embodiments, the variant glucoamylases are not 100% identical to SEQ ID NO:1.

In an additional aspect, the invention provides compositions comprising a variant glucoamylase enzyme comprising at least one amino acid substitutions as compared to SEQ ID NO:1, wherein the amino acid substitution is at a position number selected from the group consisting of: 14, 23, 30, 31, 35, 36, 39, 44, 49, 50, 51, 53, 69, 83, 98, 111, 117, 118, 119, 121, 147, 157, 179, 186, 197, 250, 262, 284, 286, 287, 288, 300, 309, 311, 317, 347, 362, 385, 388, 400, 413, 415, 419, 423, 434, 457, 463, 516, 526, 530, 533, 534, 535, 540, 545, 547, 553, 555, 564, 572, 576, 577, 581, 583, 585 and 588, wherein the variant glucoamylase enzyme has at least at least 1.1 fold better activity as compared to SEQ ID NO:1 under a condition selected from the group consisting of activity and thermoactivity at 40° C., thermostability at 57° C., thermostability at 59° C., thermostability at 62° C., thermostability at 67° C. and thermostability at 72° C. In some embodiments of this aspect, the variant enzyme is at least 95%, 96%, 97%, 98%, 99% or 100% identical to one or more of SEQ ID NO:1, SEQ ID NO:3, SEQ ID NO:5, SEQ ID NO:207, SEQ ID NO:307 and SEQ ID NO:361. In some embodiments, the variant glucoamylases are not 100% identical to SEQ ID NO:1.

In a further aspect, the invention provides variant glucoamylase enzymes comprising at least one amino acid substitutions as compared to SEQ ID NO:1, wherein the amino acid substitution is selected from the group consisting of: S14Q, K23N, K23R, K23Y, S30D, S30N, S30P, T31E, T31K, T31N, T31Q, A35L, S36R, S39A, L44I, T49K, T49R, S50E, S50I, S50N, S50Y, N51D, D53N, I69L, I69M, E83K, T98S, A111G, A117P, A117V, D118N, L119M, Q121A, Q121P, Y147W, C157W, Y179F, P186Y, Y197H, S250D, S250E, S250K, A262S, Q284H, I286A, T287N, T288H, A300L, A300Q, T309D, T309E, T309Q, L311V, A317K, L347K, T362A, S385L, S385Q, T388I, T388K, T388Y, T400K, N413S, A415D, A415F, A415N, A415S, A415T, A415W, A415Y, Q419P, Q423M, Q423P, S434T, G457N, G457P, T463F, F516L, L526F, S530E, S530G, T533K, A534L, S535E, S535G, S535K, S535T, T540A, T540S, V545L, Q547A, Q547H, F553Y, F555Y, I564F, K572E, V576I, V576L, G577R, T581I, T581K, V583F, V585P and S588Q, wherein said variant glucoamylase enzyme has at least at least 1.1 fold better activity as compared to SEQ ID NO:1 under a condition selected from the group consisting of activity and thermoactivity at 40° C., thermostability at 57° C., thermostability at 59° C., thermostability at 62° C., thermostability at 67° C. and thermostability at 72° C. In some embodiments of this aspect, the variant enzyme is at least 95%, 96%, 97%, 98%, 99% or 100% identical to one or more of SEQ ID NO:1, SEQ ID NO:3, SEQ ID NO:5, SEQ ID NO:207, SEQ ID NO:307 and SEQ ID NO:361. In some embodiments, the variant glucoamylases are not 100% identical to SEQ ID NO:1.

In an additional aspect, the invention provides compositions of variant glucoamylase enzymes that are at least 90%, 91%, 92%, 93%, 94%, 95%, 96%, 97%, 98%, 99% but less than 100% identity to the parent glucoamylase enzyme of SEQ ID NO:1.

In an additional aspect, the invention provides compositions of variant glucoamylase enzymes that are at least 90%, 91%, 92%, 93%, 94%, 95%, 96%, 97%, 98%, 99% or 100% identity to the parent glucoamylase enzyme of SEQ ID NO:3.

In an additional aspect, the invention provides compositions of variant glucoamylase enzymes that are at least 90%, 91%, 92%, 93%, 94%, 95%, 96%, 97%, 98%, 99% or 100% identity to the parent glucoamylase enzyme of SEQ ID NO:5.

In an additional aspect, the invention provides compositions of variant glucoamylase enzymes that are at least 90%, 91%, 92%, 93%, 94%, 95%, 96%, 97%, 98%, 99% or 100% identity to the parent glucoamylase enzyme of SEQ ID NO:207.

In an additional aspect, the invention provides compositions of variant glucoamylase enzymes that are at least 90%, 91%, 92%, 93%, 94%, 95%, 96%, 97%, 98%, 99% or 100% identity to the parent glucoamylase enzyme of SEQ ID NO:307.

In an additional aspect, the invention provides compositions of variant glucoamylase enzymes that are at least 90%, 91%, 92%, 93%, 94%, 95%, 96%, 97%, 98%, 99% or 100% identity to the parent glucoamylase enzyme of SEQ ID NO:361.

In a further aspect, the compositions comprising variant glucoamylase enzymes that have amino acid substitutions at one of the positions, two of the positions, three of the positions, four of the positions, five of the positions, six of the positions, seven of the positions, eight of the positions, nine of the positions, ten of the positions, eleven of the positions, twelve of the positions, thirteen of the positions, fourteen of the positions, fifteen of the positions, sixteen of the positions, seventeen of the positions, eighteen of the positions, nineteen of the positions or twenty of the positions.

In a further aspect, the invention provides compostions of a variant glucoamylase enzyme that comprises the amino acid substitution A111G. Additionally, the enzyme composition can be at least 95%, 98%, 99% or 100% identical to SEQ ID NO:3. In some aspects, the variant glucoamylase has SEQ ID NO:3.

In further aspects, the invention provides compositions of variant glucoamylase enzymes comprising A111G and at least one an amino acid substitution selected from the group consisting of: S14Q, K23N, K23R, K23Y, S30D, S30N, S30P, T31E, T31K, T31N, T31Q, A35L, S36R, S39A, L44I, T49K, T49R, S50E, S50I, S50N, S50Y, N51D, D53N, I69L, I69M, E83K, T98S, A117P, A117V, D118N, L119M, Q121A, Q121P, Y147W, C157W, Y179F, P186Y, Y197H, S250D, S250E, S250K, A262S, Q284H, I286A, T287N, T288H, A300L, A300Q, T309D, T309E, T309Q, L311V, A317K, L347K, T362A, S385L, S385Q, T388I, T388K, T388Y, T400K, N413S, A415D, A415F, A415N, A415S, A415T, A415W, A415Y, Q419P, Q423M, Q423P, S434T, G457N, G457P, T463F, F516L, L526F, S530E, S530G, T533K, A534L, S535E, S535G, S535K, S535T, T540A, T540S, V545L, Q547A, Q547H, F553Y, F555Y, I564F, K572E, V576I, V576L, G577R, T581I, T581K, V583F, V585P and S588Q.

In an additional aspect, the invention provides compositions of a variant glucoamylase enzyme that comprises the amino acid substitutions S30P/A111G. Additionally, the composition can be at least 95%, 98%, 99% or 100% identical to SEQ ID NO:5. In some aspects, the variant glucoamylase has SEQ ID NO:5.

In further aspects, the invention provides compositions of variant glucoamylase enzymes comprising S30P/A111G and at least one an amino acid substitution selected from the group consisting of: S14Q, K23N, K23R, K23Y, T31E, T31K, T31N, T31Q, A35L, S36R, S39A, L44I, T49K, T49R, S50E, S50I, S50N, S50Y, N51D, D53N, I69L, I69M, E83K, T98S, A117P, A117V, D118N, L119M, Q121A, Q121P, Y147W, C157W, Y179F, P186Y, Y197H, S250D, S250E, S250K, A262S, Q284H, I286A, T287N, T288H, A300L, A300Q, T309D, T309E, T309Q, L311V, A317K, L347K, T362A, S385L, S385Q, T388I, T388K, T388Y, T400K, N413S, A415D, A415F, A415N, A415S, A415T, A415W, A415Y, Q419P, Q423M, Q423P, S434T, G457N, G457P, T463F, F516L, L526F, S530E, S530G, T533K, A534L, S535E, S535G, S535K, S535T, T540A, T540S, V545L, Q547A, Q547H, F553Y, F555Y, I564F, K572E, V576I, V576L, G577R, T581I, T581K, V583F, V585P and S588Q.

In an additional aspect, the invention provides compositions of a variant glucoamylase enzyme that comprises the amino acid substitutions K23R/S30P/S39A/T49K/A111G/L119M/Q423P. Additionally, the composition can be at least 95%, 98%, 99% or 100% identical to SEQ ID NO:207. In some aspects, the variant glucoamylase has SEQ ID NO:207.

In further aspects, the invention provides compositions of variant glucoamylase enzymes comprising K23R/S30P/S39A/T49K/A111G/L119M/Q423P and at least one an amino acid substitution selected from the group consisting of: S14Q, T31E, T31K, T31N, T31Q, A35L, S36R, L44I, S50E, S50I, S50N, S50Y, N51D, D53N, I69L, I69M, E83K, T98S, A117P, A117V, D118N, Q121A, Q121P, Y147W, C157W, Y179F, P186Y, Y197H, S250D, S250E, S250K, A262S, Q284H, I286A, T287N, T288H, A300L, A300Q, T309D, T309E, T309Q, L311V, A317K, L347K, T362A, S385L, S385Q, T388I, T388K, T388Y, T400K, N413S, A415D, A415F, A415N, A415S, A415T, A415W, A415Y, Q419P, S434T, G457N, G457P, T463F, F516L, L526F, S530E, S530G, T533K, A534L, S535E, S535G, S535K, S535T, T540A, T540S, V545L, Q547A, Q547H, F553Y, F555Y, I564F, K572E, V576I, V576L, G577R, T581I, T581K, V583F, V585P and S588Q.

In an additional aspect, the invention provides compositions of a variant glucoamylase enzyme that comprises the amino acid substitutions K23R/S30P/S39A/L44I/T49R/N51D/A111G/A117V/L119M/N413S/Q423P. Additionally, the composition can be at least 95%, 98%, 99% or 100% identical to SEQ ID NO:307. In some aspects, the variant glucoamylase has SEQ ID NO:307.

In further aspects, the invention provides compositions of variant glucoamylase enzymes comprising K23R/S30P/S39A/L44I/T49R/N51D/A111G/A117V/L119M/N413S/Q423P and at least one an amino acid substitution selected from the group consisting of: S14Q, T31E, T31K, T31N, T31Q, A35L, S36R, S50E, S50I, S50N, S50Y, D53N, I69L, I69M, E83K, T98S, D118N, Q121A, Q121P, Y147W, C157W, Y179F, P186Y, Y197H, S250D, S250E, S250K, A262S, Q284H, I286A, T287N, T288H, A300L, A300Q, T309D, T309E, T309Q, L311V, A317K, L347K, T362A, S385L, S385Q, T388I, T388K, T388Y, T400K, A415D, A415F, A415N, A415S, A415T, A415W, A415Y, Q419P, S434T, G457N, G457P, T463F, F516L, L526F, S530E, S530G, T533K, A534L, S535E, S535G, S535K, S535T, T540A, T540S, V545L, Q547A, Q547H, F553Y, F555Y, I564F, K572E, V576I, V576L, G577R, T581I, T581K, V583F, V585P and S588Q.

In an additional aspect, the invention provides compositions of a variant glucoamylase enzyme that comprises the amino acid substitutions K23R/S30P/S39A/L44I/T49R/N51D/A111G/A117V/L119M/Q121P/T309D/A415Y/N413S/Q423P. Additionally, the composition can be at least 95%, 98%, 99% or 100% identical to SEQ ID NO:361. In some aspects, the variant glucoamylase has SEQ ID NO:361.

In further aspects, the invention provides compositions of variant glucoamylase enzymes comprising K23R/S30P/S39A/L44I/T49R/N51D/A111G/A117V/L119M/Q121P/T309D/A415Y/N413S/Q423P and at least one an amino acid substitution selected from the group consisting of: S14Q, T31E, T31K, T31N, T31Q, A35L, S36R, S50E, S50I, S50N, S50Y, D53N, I69L, I69M, E83K, T98S, D118N, Y147W, C157W, Y179F, P186Y, Y197H, S250D, S250E, S250K, A262S, Q284H, I286A, T287N, T288H, A300L, A300Q, L311V, A317K, L347K, T362A, S385L, S385Q, T388I, T388K, T388Y, T400K, Q419P, S434T, G457N, G457P, T463F, F516L, L526F, S530E, S530G, T533K, A534L, S535E, S535G, S535K, S535T, T540A, T540S, V545L, Q547A, Q547H, F553Y, F555Y, I564F, K572E, V576I, V576L, G577R, T581I, T581K, V583F, V585P and S588Q.

In an additional aspect, the invention provides variant glucoamylase enzymes having amino acid substitutions as compared to SEQ ID NO:1 selected from the group consisting of: A111G/Q547A, A111G, A111G/Y179F, I69M/A111G/Q547H, I69L/A111G, A111G/Q419P, A111G/F555Y, I69L/A111G/Q547A, A111G/L311V, A111G/I286A/T288H/L311V/F516L/Q547A, Q547A, A111G/F516L/F555Y, A111G/A262S/Q547A, A111G/Y179F/A262S, A111G/Y147W, A117V/I564V, T98S/A117V/I564V, A117V, A117V/Q284H/T287N/I564V, I564V, T98S/A117V, V545L, A117V/F553Y, A117V/S434T, A117V/Y197H/V545L, T98S/A117V/F553Y, S30N/A111G, T49R/A111G, L44I/A111G, A111G/A117P, S30P/A111G, K23N/A111G, T31N/A111G, T31E/A111G, D53N/A111G, N51D/A111G, S39A/A111G, K23R/A111G, A35L/A111G, T31Q/A111G, T31K/A111G, S50I/A111G, S50Y/A111G, T49K/A111G, K23Y/A111G, S50E/A111G, S36R/A111G, S30D/A111G, A111G/S530E, A111G/T540S, A111G/S535E, A111G/S530G, A111G/T533K, A111G/A534L, A111G/S535T, A111G/Q423P, A111G/Q423M, A111G/Q121A, A111G/S535G, A111G/T540A, A111G/L119M, A111G/Q121P, A111G/S535K, A111G/V585P, A111G/V583F, A111G/G577R, A111G/T581K, A111G/V576I, A111G/K572E, A111G/V576L, A111G/S588Q, A111G/T581I, S30P/A111G/N413S, S30P/A111G/N413D, S30P/A111G/T362A, S30P/A111G/G457P, S30P/A111G/T463F, S30P/A111G/A317K, S30P/A111G/T388K, S30P/A111G/T388I, S30P/A111G/T388Y, S30P/A111G/G457N, S30P/A111G/P186Y, S30P/A111G/K23R/S39A/N51D, S30P/A111G/K23R/S39A/S50E/L119M/Q121P, S30P/A111G/K23R/T49K/S50E, S30P/A111G/K23R/S50E/N51D/A117V/L119M, S30P/A111G/L119M/Q121A, S30P/A111G/S39A/S50I/N51D/Q423P, S30P/A111G/Q423P, S30P/A111G/K23R/Q423P, S30P/A111G/A117P, S30P/A111G/S39A/A117V, S30P/A111G/S39A/T49R/L119M, S30P/A111G/T49K/Q423P, S30P/A111G/N51D/L119M, S30P/A111G/A117V/L119M/Q121P/Q423P, S30P/A111G/T49R/A117P/L119M, S30P/A111G/L119M, S30P/A111G/S39A/T49K/S50I/N51D, S30P/A111G/A117V, S30P/A111G/S39A, S30P/A111G/K23R/S39A/T49K/L119M/Q423P, S30P/A111G/K23R/T49R, S30P/A111G/K23R/N51D/L119M/Q121P, S30P/A111G/L44I/A117V/L119M, S30P/A111G/T31K/L119M/Q423P, S30P/A111G/L44I, S30P/A111G/A415N, S30P/A111G/T400K, S30P/A111G/A415D, S30P/A111G/A415Y, S30P/A111G/L347K, S30P/A111G/A415T, S30P/A111G/A415W, S30P/A111G/A415F, S30P/A111G/T309Q, S30P/A111G/S385L, S30P/A111G/S385Q, S30P/A111G/S250E, S30P/A111G/T309E, S30P/A111G/T309D, S30P/A111G/S14Q, S30P/A111G/S250D, S30P/A111G/S250K, S30P/A111G/A300Q, S30P/A111G/A300L, K23R/S39A/T49K/L119M/Q423P/T31E/N51D/Q121P, K23R/S39A/T49R/L119M/Q423P/T31E/N413D, K23R/S39A/T49R/L119M/Q423P/T31E/N51D, K23R/S39A/T49K/L119M/Q423P/L44I/A117V, K23R/S39A/T49K/L119M/Q423P/Q121P/N413S, K23R/S39A/T49K/L119M/Q423P/N413D, K23R/S39A/T49R/L119M/Q423P/N51D/N413S, K23R/S39A/T49R/L119M/Q423P/T31E/A117V/N413S, K23R/

S39A/T49K/L119M/Q423P/T31E/L44I/N51D/A117V, K23R/S39A/T49R/L119M/Q423P/T31E/N51D/N413D, K23R/S39A/T49R/L119M/Q423P/L44I/N51D/N413D, K23R/S39A/T49R/L119M/Q423P/T31E/S50N/N51D/ C157W, K23R/S39A/T49R/L119M/Q423P/N51D, K23R/ S39A/T49R/L119M/Q423P/L44I/N51D, K23R/S39A/ T49R/L119M/Q423P/L44I/A117V, K23R/S39A/T49K/ L119M/Q423P/L44I/N51D/A117V/Q121A, K23R/S39A/ T49R/L119M/Q423P/T31E/L44I/A117V, K23R/S39A/ T49K/L119M/Q423P/L44I/N51D/A117V, K23R/S39A/ T49R/L119M/Q423P/T31E/L44I/N51D/A117V/N413S, K23R/S39A/T49K/L119M/Q423P/A117V/Q121A/N413D, K23R/S39A/T49R/L119M/Q423P/T31E/L44I/A117V/ Q121P, K23R/S39A/T49K/L119M/Q423P/N51D, K23R/ S39A/T49R/L119M/Q423P/T31E/L44I/Q121P/N413S, K23R/S39A/T49R/L119M/Q423P/L44I/Q121P, K23R/ S39A/T49R/L119M/Q423P/L44I/N413S, K23R/S39A/ T49R/L119M/Q423P/L44I/N51D/A117V/N413S, K23R/ S39A/T49K/L119M/Q423P/N51D/A117V/N413S, K23R/ S39A/T49K/L119M/Q423P/N51D/N413S, K23R/S39A/ T49R/L119M/Q423P/T31E/L44I, K23R/S30P/S39A/L44I/ T49R/N51D/A111G/A117V/L119M/N413S/Q423P/T31E/Q121A/S413D, K23R/S30P/S39A/L44I/T49R/N51D/A111G/A117V/L119M/N413S/Q423P/Q121P/S413D/A415N, K23R/S30P/S39A/L44I/T49R/N51D/A111G/A117V/L119M/N413S/Q423P/A415W, K23R/S30P/S39A/T49K/A111G/L119M/Q423P/A415F, K23R/S30P/S39A/L44I/T49R/N51D/A111G/A117V/L119M/N413S/Q423P/T309D/A415S, K23R/S30P/S39A/L44I/T49R/N51D/A111G/A117V/L119M/N413S/Q423P/T309E, K23R/S30P/S39A/L44I/T49R/N51D/A111G/A117V/L119M/N413S/Q423P/T309E/A415W, K23R/S30P/S39A/L44I/T49R/N51D/A111G/A117V/L119M/N413S/Q423P/A415D, K23R/S30P/S39A/L44I/T49R/N51D/A111G/A117V/L119M/N413S/Q423P/E83K/D118N/, K23R/S30P/S39A/L44I/T49R/N51D/A111G/A117V/L119M/N413S/Q423P/R49K, K23R/S30P/S39A/L44I/T49R/N51D/A111G/A117V/L119M/N413S/Q423P/T31E/A415F, K23R/S30P/S39A/L44I/T49R/N51D/A111G/A117V/L119M/N413S/Q423P/A415Y, K23R/S30P/S39A/L44I/T49R/N51D/A111G/A117V/L119M/N413S/Q423P/T31E/T309E/A415W, K23R/S30P/S39A/L44I/T49R/N51D/A111G/A117V/L119M/N413S/Q423P/T31E/R49K/Q121A/A41 5W, K23R/S30P/S39A/L44I/T49R/N51D/A111G/A117V/L119M/N413S/Q423P/T31E/A415Y, K23R/S30P/S39A/L44I/T49R/N51D/A111G/A117V/L119M/N413S/Q423P/R49K/T309E/A415D, K23R/S30P/S39A/L44I/T49R/N51D/A111G/A117V/L119M/N413S/Q423P/T31E/R49K/T309D/A41 5F/L526F, K23R/S30P/S39A/L44I/T49R/N51D/A111G/A117V/L119M/N413S/Q423P/T31E/T309D, K23R/S30P/S39A/L44I/T49R/N51D/A111G/A117V/L119M/N413S/Q423P/Q121P/T309E/A415F, K23R/S30P/S39A/L44I/T49R/N51D/A111G/A117V/L119M/N413S/Q423P/S413D/A415N, K23R/S30P/S39A/L44I/T49R/N51D/A111G/A117V/L119M/N413S/Q423P/T31E/Q121P/A415Y, K23R/S30P/S39A/L44I/T49R/N51D/A111G/A117V/L119M/N413S/Q423P/Q121A/A415Y, K23R/S30P/S39A/L44I/T49R/N51D/A111G/A117V/L119M/N413S/Q423P/T309D/A415W and K23R/S30P/S39A/L44I/T49R/N51D/A111G/A117V/L119M/N413S/Q423P/Q121P/T309D/A415Y.

In an additional aspect, the invention provides enzymatically active variant glucoamylases having the sequence:

SPVSKRATLDEFI-X14-TERPLALE-X23-LLCNIG-X30-X31-GCR-X35-X36-GA-X39-SGVV-X44-ASPS-X49-X50-X51-P-X53-YYYTWTRDAALVFKE-X69-VDSVETNTTLLLP-X83-IENYVTAQAYLQTV-X98-NPSGSLSDGAGL-X111-EPKFN-X117-X118-X119-T-X121-FTGAWGRPQRDGPALRATAMIAYYN-X147-LLNNNATTD-X157-GLWQIIQNDLNYVAQYWNQTG-X179-DLWEEV-X186-GSSFFTVAAQ-X197-RALVEGSTLAAKLGKSHSAYDTVAPQILCYLQSFWSSSKGYIVANTQTASWV-X250-RSGLDANTPLT-X262-IHLFDPELGCDDSTFQPCSPK-X284-L-X286-X287-X288-KKLVDSFRSIY-X300-INSGKSAG-X309-A-X311-AVGRY-X317-EDVYYNGNPWYLCTLAVAEQLYDAVYTWK-X347-EGSITVTSVSLPFF-X362-DLLPSLTTGTYASGSTTFESII-X385-AV-X388-TYADGFVSIVQ-X400-YTPSDGALSEQY-X413-K-X415-NGQ-X419-LSA-X423-DLTWSYAAFL-X434-ATERRDSVVPAGWAGASSVSVP-X457-ACAAT-X463-VVGTYAAASNCGTPGSGSGGNGGSSGNALVTFNELATTYYGENIKLVGSTAA-X516-GSWSPSAGI-X526-LSA-X530-SY-X533-X534-X535-NPLW-X540-TTVS-X545-P-X547-GSTVE-X553-K-X555-IRVGSDGS-X564-TWESGNN-X572-VLT-X576-X577-SSA-X581-S-X583-T-X585-SA-X588-WNGAYSVSSS, wherein X14 is selected from the group consisting of S and Q; X23 is selected from the group consisting of K, N, R and Y; X30 is selected from the group consisting of S, D, N and P; X31 is selected from the group consisting of T, E, K, N and Q; X35 is selected from the group consisting of A and L; X36 is selected from the group consisting of S and R; X39 is selected from the group consisting of S and A; X44 is selected from the group consisting of L and I; X49 is selected from the group consisting of T, K and R; X50 is selected from the group consisting of S, E, I, N and Y; X51 is selected from the group consisting of N and D; X53 is selected from the group consisting of D and N; X69 is selected from the group consisting of I, L and M; X83 is selected from the group consisting of E and K; X98 is selected from the group consisting of T and S; X111 is selected from the group consisting of A and G; X117 is selected from the group consisting of A, P and V; X118 is selected from the group consisting of D and N; X119 is selected from the group consisting of L and M; X121 is selected from the group consisting of Q, A and P; X147 is selected from the group consisting of Y and W; X157 is selected from the group consisting of C and W; X179 is selected from the group consisting of Y and F; X186 is selected from the group consisting of P and Y; X197 is selected from the group consisting of Y and H; X250 is selected from the group consisting of S, D, E and K; X262 is selected from the group consisting of A and S; X284 is selected from the group consisting of Q and H; X286 is selected from the group consisting of I and A; X287 is selected from the group consisting of T and N; X288 is selected from the group consisting of T and H; X300 is selected from the group consisting of A, L and Q; X309 is selected from the group consisting of T, D, E and Q; X311 is selected from the group consisting of L and V; X317 is selected from the group consisting of A and K; X347 is selected from the group consisting of L and K; X362 is selected from the group consisting of T and A; X385 is selected from the group consisting of S, L and Q; X388 is selected from the group consisting of T, I, K and Y; X400 is selected from the group consisting of T and K; X413 is selected from the group consisting of N and S; X415 is selected from the group consisting of A, D, F, N, S, T, W and Y; X419 is selected from the group consisting of Q and P; X423 is selected from the group consisting of Q, M and P; X434 is selected from the group consisting of S and T; X457 is selected from the group consisting of G, N and P; X463 is selected from the group consisting of T and F; X516 is selected from the group consisting of F and L; X526 is selected from the group consisting of L and F; X530 is selected from the group consisting of S, E and G; X533 is selected from the group consisting of T and K; X534 is selected from the group consisting of A and L; X535 is selected from the group consisting of S, E, G, K and T; X540 is selected from the group consisting of T, A and S; X545 is selected from the group consisting of V and L; X547 is selected from the group consisting of Q, A and H; X553 is selected from the group consisting of F and Y; X555 is selected from the group consisting of F and Y; X564 is selected from the group consisting of I and F; X572 is selected from the group consisting of K and E; X576 is selected from the group consisting of V, I and L; X577 is selected from the group consisting of G and R; X581 is selected from the group consisting of T, I and K; X583 is selected from the group consisting of V and F; X585 is selected from the group consisting of V and P; X588 is selected from the group consisting of S and Q; and wherein the variant is not SEQ ID NO:1.

In an additional aspect, the variant glucoamylase enzyme comprises an amino acid sequence selected from the group consisting of the odd numbered sequences of SEQ ID NOs:1 to 361.

In an additional aspect, the invention provides compositions of variant glucoamylases further comprising animal feed.

In a further aspect, the invention provides nucleic acids encoding the variant glucoamylase enzymes of the invention.

In an additional aspect, the invention provides expression vectors comprising the nucleic acids encoding the variant glucoamylase enzymes of the invention.

In a further aspect, the invention provides host cells comprising the expression vectors or the nucleic acids of the invention.

In an additional aspect, the invention provides methods of making a variant glucoamylase enzyme comprising culturing the host cells of the invention under conditions wherein the variant glucoamylase enzyme is produced, and recovering the enzyme.

In some aspects, the invention relates to glucoamylase variants having improved thermal properties, such as thermostability, heat-stability, steam stability, temperature profile, and/or pelleting stability, with thermostable variant enzymes of particular use in many embodiments.

In additional aspects, the invention relates to glucoamylase variants having improved pelleting stability and/or improved acid-stability.

In further aspects, the invention provides methods of starch processing comprising contacting a starch substrate with a novel variant glucoamylase of the invention under conditions wherein the starch is degraded.

BRIEF DESCRIPTION OF THE DRAWINGS

FIG. 3 provides thermostability improvement data for various second generation variant glucoamylase enzymes. The values of the table were determined as described in Example 1. The variants are shown relative to the G1P wild type sequence, SEQ ID NO:1. G2P is shown and has a single amino acid substitution, A111G.

FIGS. 4A and 4B provide thermostability improvement data for various third generation variant glucoamylase enzymes. The values of the table were determined as described in Example 1. The variants are shown relative to the G2P sequence, SEQ ID NO:3; that is, all the variants in FIG. 4 also have the G2P modification, A111G. G3P is identified and has an additional S30P variant, thus G3P is a double variant of S30P/A111G.

FIGS. 5A, 5B, and 5C provide thermostability improvement data for various fourth generation variant glucoamylase enzymes. The values of the table were determined as described in Example 1. The variants are shown relative to the G3P sequence, SEQ ID NO:5; that is, all the variants in FIG. 5 also have the G3P modifications, S30P/A111G. G4P is identified and has an additional five variants, thus G4P is a variant comprising seven amino acid substitutions, K23R/ S30P/S39A/T49K/A111G/L119M/Q423P.

FIGS. 6A and 6B provide thermostability improvement data for various fifth generation variant glucoamylase enzymes. The values of the table were determined as described in Example 1. The variants are shown relative to the G4P sequence, SEQ ID NO:207; that is, all the variants in FIG. 6 also have the G4P modifications, including K23R/ S30P/S39A/A111G/L119M/Q423P. It should be noted, however, that the lysine at position 49 that is contained within G4P is an arginine in G5P; thus, some of the variants in FIG. 6 are listed as "(T/K)49R", meaning that the lysine of G4P was mutated to an arginine although the wild-type residue is a threonine. G5P is identified and has an additional five variants, thus G5P is a variant comprising eleven amino acid substitutions, K23R/S30P/S39A/L44I/T49R/N51D/A111G/ A117V/L119M/N413S/Q423P.

FIG. 7 provides thermostability improvement data for various sixth generation variant glucoamylase enzymes. The values of the table were determined as described in Example 1. The variants are shown relative to the G5P sequence, SEQ ID NO:307; that is, all the variants in FIG. 7 also have the G5P modifications, including K23R/S30P/S39A/L44I/ T49R/N51D/A111G/A117V/L119M/N413S/Q423P. G6P is identified and has an additional three variants, thus G6P is a variant comprising fourteen amino acid substitutions, K23R/

Figure 1:
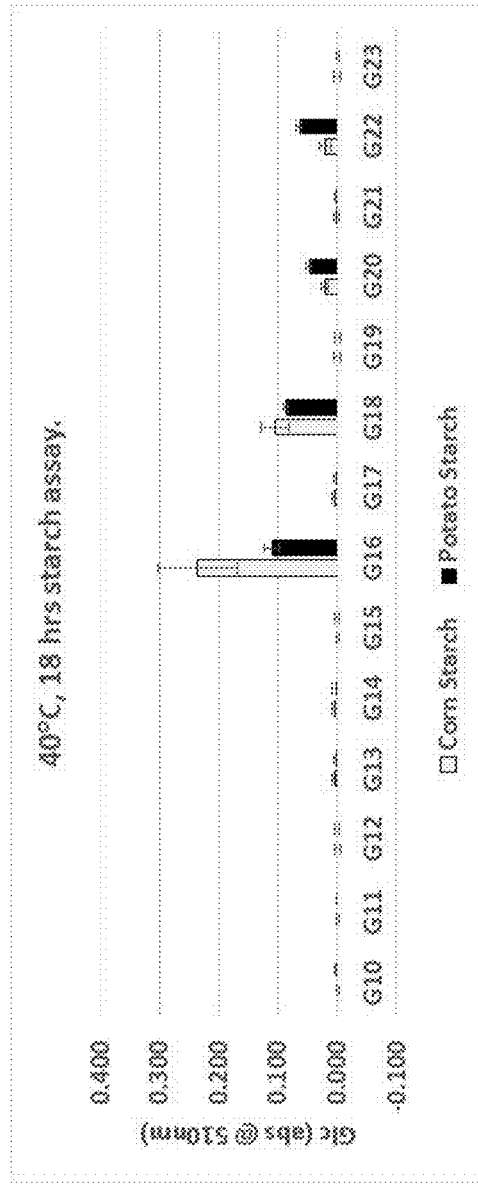
FIG. 1 provides data regarding the activity of various glycoamylases activity on starch substrates. For the assay, 150 µL of 1% corn starch vs. potato starch (final concentration of 0.75% starch), 25 µL lysate plus 25 µL pH 5.5 buffer was incubated for 18 hours at 40° C. with 650 rpm agitation. 20 µL of the incubated sample was added to 180 µL GOPOD (glucose oxidase/peroxidase) and incubated for 30 minutes at 50° C. with 150 RPM agitation. Absorbance was read at 510 nm to determine glucose released.

S30P/S39A/L44I/T49R/N51D/A111G/A117V/L119M/ Q121P/T309D/N413S/A415Y/Q423P.

FIGS. 8A, 8B, and 8C provide a schematic of the domains of the glucoamylase of SEQ ID NO:1 (G1P), SEQ ID NO:3 (G2P), SEQ ID NO:5 (G3P), SEQ ID NO:207 (G4P), SEQ ID NO:307(G5P) and SEQ ID NO:361 (G6P). The signal sequence, containing the first 22 amino acids, is double underlined. The catalytic domain is bolded and underlined, with the catalytic residues in large italic font and the substrate binding residues in large bolded font. Note that the number of FIG. 6 is inclusive of the signal peptide, which is not the numbering of the variant positions outlined herein; that is, the variant positions herein count the alanine (A) residue as position 1 of the mature protein. Thus, the catalytic domain is amino acids 42-457 in the figure but amino acids 20 to 435 in the mature protein. Similarly, the D202 and E205 catalytic residues of the figure are D180 and E183 in mature numbering, and the substrate binding residue is W148 in the Figure but W126 in the mature protein.

FIGS. 9A and 9B depict a variant table showing some preferred variants in some embodiments of the invention. As described herein, these may be combined in any combination, and with variant sets as outlined herein.

FIGS. 10A, 10B, 10C, 10D, 10E and 10F depict the amino acid and nucleic acid sequences of G1P, G2P, G3P, G4P, G5P and G6P as well as the endogeneous 1900+ base pair sequence in *Thielaviopsis punctuala* upstream of the coding region, that contains the promoter. As will be appreciated by those in the art, the exact length of the promoter is not known, with promoters generally being located near the transcription site of the gene, and can be anywhere from roughly 100 to 1000 basepairs long. Thus, for the purposes outlined herein, the promoter is inclusive of at least 100 upstream base pairs of the sequence shown in the figure.

DETAILED DESCRIPTION OF THE INVENTION

I. Introduction

Starch is the major carbohydrate reserve polymer found in a number of important food plant sources, including corn, wheat, potatoes, rice, cassava, oats and others. Starch is used as the substrate for the production of glucose, which in turn is used to make a number of products including liquid fuels (sometimes referred to herein as "biofuels"), proteins, sugars and chemicals, and is used extensively in the food industry. The convention conversion of starch to glucose requires a two step process of liquefaction (converting the solid starchy substrate into a more useable mash) and saccharification (breaking down the mash into simple sugars). Glucoamylase is used in saccharification reactions to release glucose as the final end product, which in turn can be used to produce food, beverages and biofuels. Glucoamylases generally have two domains, a catalytic domain for the actual conversion and a starch binding domain, which allows the phase transfer of a soluble enzyme to the insoluble starch substrate.

However, many of the industrial processes that utilize glucoamylases are run under generally harsh conditions such as high temperature; accordingly, thermostable glucoamylases are desired and provided herein. The glucoamylase from *Thielaviopsis punctuala*, KKA29558, was surprisingly found to have significant thermostability.

II. Definitions

By "exogeneous" in the context of nucleic acid sequences herein is meant that the exogeneous element is not normally associated with the second element in nature, and is thus an artificial or synthetic construct. For example, the wild-type gene encoding the *Thielaviopsis punctuala* G1P enzyme of the invention is normally associated with its endogeneous promoter (contained within SEQ ID NO:363, shown in FIG. 10). Thus, in many embodiments the invention provides nucleic acid constructs that comprise the coding sequence of a glucoamylase liked to exogeneous construct sequences such as an exogeneous promoter. For clarity, in general the reference to "exogeneous" is in reference to the glucoamylase and not the host cell. For example, if the host cell is an *A. niger* cell, the promoter that is operably linked to the glucoamylase gene may be endogeneous to *A. niger* but exogeneous to the glucoamylase (for example, the promoter from *A. niger* α-amylase can be linked to the glucoamylases of the invention). Similarly, the gene encoding the G1P enzyme is exogeneous to any host cell that is not *T. punctuala*. Accordingly, in some embodiments, the invention provides nucleic acid constructs that encode both a glucoamylase enzyme (whether wild type or variant) operably linked to exogeneous construct nucleic acid sequences. By "exogeneous construct sequence" herein is meant a construct sequence (whether amino acid or nucleic acid sequences, although as will be appreciated by the context in which the term is used, usually refers to the nucleic acid sequence) that is not normally associated with the nucleic acid encoding the glucoamylase.

Suitable construct sequences that can be included in extrachromosomal or integrating expression vectors include, but are not limited to, selectable markers, purificaiton tags, origin(s) of replication and regulatory sequences including but not limited to promoters (inducible and constituative), enhancers, ribosomal binding sites, start codons, termination codons, Shine-Dalgarno sequences, etc.

By "selection marker" or "selectable marker" or "selection protein" herein is meant a protein that is introduced into a host cell that confers a trait suitable for artificial selection during the growth of the host cells, such that only those cells that contain the selectable marker grow. Thus, a selectable marker is a gene the product of which provides for biocide or viral resistance, resistance to heavy metals, prototrophy to auxotrophs, and the like. Examples of selection markers are outlined below. Accordingly, a "selection gene" is a nucleic acid that encodes a selection protein.

By "extrachromosomal expression vector" (also generally referred to as a "plasmid") herein is meant a self-replicating expression vector (generally a plasmid) that carries genes of interest, which remains within the cell and does not integrate into the genome of the host cell.

By "integrating expression vector" herein is meant a vector that is designed to be inserted into the genome of the host cell, sometimes referred to as "episomes".

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E75D refers to a variant polypeptide, in this case a glucoamylase, in which the glutamic acid at position 75 is replaced with aspartic acid. Multiple mutations are separated by forward slash marks ("/"), e.g., "A114G/I190V/S204A" representing substitutions at positions 114, 190 and 204, respectively (in some cases a "+" can be used). For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, −233E or 233E designates an insertion of glutamic acid after position 233 and before position 234. Additionally, −233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233- or E233#, E233( ) or E233del designates a deletion of glutamic acid at position 233. Additionally, EDA233- or EDA233# designates a deletion of the sequence GluAspAla that begins at position 233.

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. In the present case, some embodiments utilize G1P, G2P, G3P, G4P, G5P or G6P as parent polypeptides, with the former being preferred.

By "variant protein" or "protein variant", or "variant" as used herein is meant a protein that differs from that of a parent protein by virtue of at least one amino acid modification. Protein variant may refer to the protein itself, a composition comprising the protein, or the amino sequence that encodes it. Preferably, the protein variant has at least one amino acid modification compared to the parent protein, e.g. from about one to about seventy amino acid modifications, and preferably from about one to about five amino acid modifications compared to the parent. As described below, in some embodiments the parent polypeptide is a wild type sequence, designated "G1P" herein. As further discussed below, the protein variant sequence herein will preferably possess at least about 80% identity with a parent protein sequence, and most preferably at least about 90% identity, more preferably at least about 95-98-99% identity. Variant protein can refer to the variant protein itself, compositions comprising the protein variant, or the DNA sequence that encodes it. Thus, by "variant glucoamylase" herein is meant a novel glucoamylase that has at least one amino acid modification in the amino acid sequence as compared to a parent glucoamylase enzyme. As discussed herein, in some cases the parent glucoamylase is a second or higher generation of variant; that is, as shown in FIG. 3, the G2P glucoamylase has 1 amino acid substitution as compared to the wild type G1P parent. However, as shown in FIG. 4, the G3P has 1 amino acid substitution as compared to the G2P parent, but a total of 2 amino acid substitutions as compared to the G1P. Unless otherwise noted or as will be obvious from the context, the variant glucoamylases of the invention generally are compared to the wild type G1P sequence. Additionally, unless otherwise noted, the variant glucoamylases of the invention are enzymatically active, that is, there is detectable glucoamylase activity using the glucoamylase assay described in Example 1 and below, using an assay without temperature treatment.

As used herein, "protein" herein is meant at least two covalently attached amino acids, which includes proteins, polypeptides, oligopeptides and peptides. The peptidyl group generally comprise naturally occurring amino acids and peptide bonds. In addition, polypeptides may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Glutamic Acid 75 (also referred to as Glu75 or E75) is a residue at position 75 in the G1P parental enzyme.

By "non-naturally occurring modification" as used herein is meant an amino acid modification that is not found in the parent (e.g. G1P) enzyme.

By "amino acid" and "amino acid identity" as used herein is meant one of the 20 naturally occurring amino acids that are coded for by DNA and RNA.

By "position" as used herein is meant a location in the sequence of a protein. In general, the position number (which is more fully discussed below) is relative to the first amino acid of the mature glucoamylase sequence, e.g. excluding the signal peptide.

The term "glucoamylase" (1,4-alpha-D-glucan glucohydrolase, EC 3.2.1.3) is defined as an enzyme, which catalyzes the release of D-glucose from the non-reducing ends of starch or related oligosaccharide and polysaccharide molecules. For purposes of the present invention, glucoamylase activity is determined according to the procedures described in the Examples herein, for example the Starch Assay to determine glucoamylase activity in Example 1.

The term "coding sequence" refers to a polynucleotide, which directly specifies the amino acid sequence of a variant. The boundaries of the coding sequence are generally determined by an open reading frame, which begins with a start codon such as ATG, GTG or TTG and ends with a stop codon such as TAA, TAG, or TGA. The coding sequence may be a genomic DNA, cDNA, synthetic DNA, or a combination thereof.

The term "control sequences" means nucleic acid sequences necessary for expression of a polynucleotide encoding a variant of the present invention. Each control sequence may be native (i.e., from the same gene) or foreign (i.e., from a different gene) to the polynucleotide encoding the variant or native or foreign to each other. Such control sequences include, but are not limited to, a leader, polyadenylation sequence, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the polynucleotide encoding a variant.

The term "expression" includes any step involved in the production of a variant glucoamylase described herein, including, but not limited to, transcription, post-transcriptional modification, translation, post-translational modification, and secretion.

The term "expression vector" refers to a linear or circular DNA molecule that comprises a polynucleotide encoding a variant and is operably linked to control sequences that provide for its expression.

The term "fragment" means a polypeptide having one or more (e.g., several) amino acids absent from the amino and/or carboxyl terminus of a mature polypeptide. A "glucoamylase fragment" herein means a portion of an amino acid sequence depicted herein that maintains maintains glucoamylase activity. As shown in FIG. 5, the parental glucoamylase enzyme of the invention (G1P) comprises a starch binding domain and a catalytic domain. In some applications, particularly for starch processing, both domains are desirable. In other applications, only the catalytic domain is desired. In one aspect, a fragment contains at least 250, at least 300, at least 350, or at least 400 amino acid residues (e.g., amino acids 42 to 457 (numbering inclusive of the signal peptide) of SEQ ID NO: 1; see underlining portion of the sequence in FIG. 8), comprising the catalytic domain and having one or more of the substitutions according to the invention. In some embodiments, the fragment is at least 380, at least 390, at least 400, at least 410 or at least 420 amino acid residues. In some embodiments, the fragment is at least 405, at least 406, at least 407, at least 408, at least 409, at least 410, at least 411, at lest 412, at least 413, at least 414, or at least 415 amino acid residues.

The term "host cell" refers to any cell type that is susceptible to transformation, transfection, transduction, or the like with a nucleic acid construct or expression vector comprising a polynucleotide of the present invention, and that allows for expression of the enzyme. The term "host cell" encompasses any progeny of a parent cell that is not identical to the parent cell due to mutations that occur during replication. In many embodiments, the host cell is not a *Thielaviopsis punctuala* cell; that is, the glucoamylase of the invention (including both the wild type sequence of SEQ ID NO:1 and variant enzymes described herein) are not produced in the endogenous host.

The term "improved property" refers to a characteristic associated with a variant glucoamylase enzyme described herein that is improved compared to the parent glucoamylase enzyme. Such improved properties include, but are not limited to, specific activity, reduced glucose inhibition, reduced isomaltose forming activity, increased activity on maltodextrin DE11-14, increased thermostability (e.g., increased stability at higher temperature), and increased pH stability (e.g., increase stability at higher pH). A further improved property is increased EtOH yield when the variant glucoamylase enzymes is applied in saccharification followed by fermentation on a liquefied mash.

The term "isolated" refers to a substance in a form or environment which does not occur in nature. Non-limiting examples of isolated substances include (1) any non-naturally occurring substance, (2) any substance including, but not limited to, any enzyme, variant, nucleic acid, protein, peptide or cofactor, that is at least partially removed from one or more or all of the naturally occurring constituents with which it is associated in nature; (3) any substance modified by the hand of man relative to that substance found in nature; or (4) any substance modified by increasing the amount of the substance relative to other components with which it is naturally associated (e.g., multiple copies of a gene encoding the substance; use of a stronger promoter than the promoter naturally associated with the gene encoding the substance, etc.). With specific reference to isolated glucoamylases having SEQ ID NO:1, the isolated glucoamylase is generally either: a) purified away from other proteins with which it is normally associated, for example when it is produced in *T. punctuala* but at least some of the other secreted proteins are removed or the host cells are removed; b) when the enzyme is in a concentration not found in nature, or c) when the enzyme is produced in a host cell that is not *T. punctuala*.

The term "mature polypeptide" means a polypeptide in its final form following translation and any post-translational modifications, such as N-terminal processing, C-terminal truncation, glycosylation, phosphorylation, etc.

The phrase "mature polypeptide coding sequence" refers to a polynucleotide that encodes a mature polypeptide having glucoamylase activity.

The term "nucleic acid construct" refers to a nucleic acid molecule, either single-stranded or double-stranded, which is isolated from a naturally occurring gene or is modified to contain segments of nucleic acids in a manner that would not otherwise exist in nature or which is synthetic, and which comprises one or more control sequences.

The term "operably linked" refers to a configuration in which a construct sequence is placed at an appropriate position relative to the coding sequence of a polynucleotide such that the control sequence directs, allows or facilitates expression of the coding sequence.

The terms "parent" or "parent glucoamylase" refer to a glucoamylase to which an alteration is made to produce the variant glucoamylases of the present invention. The parent may be a naturally occurring (wild-type) polypeptide or a variant or fragment thereof. An exemplary parent polypeptide of the present invention is SEQ ID NO:1.

The relatedness between two amino acid sequences or between two nucleotide sequences is described by the parameter "sequence identity". For purposes of the present invention, the sequence identity between two amino acid sequences is determined using the Needleman-Wunsch algorithm (Needleman and Wunsch, 1970, *J. Mol. Biol.* 48: 443-453) as implemented in the Needle program of the EMBOSS package (EMBOSS: The European Molecular Biology Open Software Suite, Rice et al., 2000, *Trends Genet.* 16: 276-277), preferably version 5.0.0 or later. The parameters used are gap open penalty of 10, gap extension penalty of 0.5, and the EBLOSUM62 (EMBOSS version of BLOSUM62) substitution matrix. The output of Needle labeled "longest identity" (obtained using the –nobrief option) is used as the percent identity and is calculated as follows:

$$(\text{Identical Residues} \times 100)/(\text{Length of Alignment} - \text{Total Number of Gaps in Alignment})$$

The term "subsequence" refers to a polynucleotide having one or more (e.g., several) nucleotides absent from the 5'- and/or 3'-end of a mature polypeptide coding sequence; wherein the subsequence encodes a fragment having glucoamylase activity. In one aspect, a subsequence encodes at least the catalytic domain of the variant according to the invention. (e.g., nucleotides coding for the underlined portion as shown in FIG. 8).

The term "variant" refers to a polypeptide having glucoamylase activity and which comprises an alteration, i.e., a substitution, insertion, and/or deletion, at one or more (e.g., several) positions. A substitution means replacement of the amino acid occupying a position with a different amino acid; a deletion means removal of the amino acid occupying a position; and an insertion means adding an amino acid adjacent to and immediately following the amino acid occupying a position.

The term "wild-type" glucoamylase means a glucoamylase expressed by a naturally occurring microorganism, such as a bacterium, yeast, or filamentous fungus found in nature. In general, the wild-type glucoamylase of most interest herein is G1P, SEQ ID NO:1.

III. Glucoamylases of the Invention

The invention provides thermostabile and/or thermoactive glucoamylases for use in a variety of applications, including feed supplements and starch processing. The invention provides compositions and methods using a *Thielaviopsis punctuala* glucoamylase, SEQ ID NO:1, as well as variants thereof, as more fully described below.

IV. Variant Glucoamylases of the Invention

Accordingly, the present invention provides variant glucoamylases with improved activity that can be used in a variety of applications, including saccharification reactions, animal and human nutritional and feed products and the production of biofuels such as bioethanol.

In general, the variant glucoamylases of the invention have modified, improved biochemical properties as compared to the wild type parental G16 glucoamylase, or "G1P" (e.g. "generation 1 parent"), SEQ ID NO:1 herein, as shown in FIG. 10. The biochemical properties of the variant glucoamylases that can be improved herein include, but are not limited to, pH activity, pH stability, thermostability, specific activity, activity and thermoactivity, formulation stability (including liquid, solid and pellets), performance in animals and/or animal feed and protease stability.

The variant glucoamylases of the invention have one or more improved properties as compared to G1P. By "improved" herein is meant a desirable change of at least one biochemical property. "Improved function" can be measured as a percentage increase or decrease of a particular activity, or as a "fold" change, with increases of desirable properties (e.g. pH stability, thermostability) or decreases of undesirable properties (e.g. protease sensitivity). That is, a variant glucoamylase may have a 10% increase in thermostability or a 10% decrease in protease sensitivity, as compared to G1P. Alternatively, a variant glucoamylase may have a 2-fold increase in pH stability or a 3-fold decrease in protease sensitivity. In general, percentage changes are used to describe changes in biochemical activity of less than 100%, and fold-changes are used to describe changes in biochemical activity of greater than 100% (as compared to the parental enzyme, in many cases G1P). In the present invention, percentage changes (usually increases) of biochemical activity of at least about 10%, 20%, 30%, 40%, 50%, 60%, 70%, 80%, 90%, 95%, 98% and 99% can be accomplished. In the present invention, a "fold increase" (or decrease) is measured as compared to the starting or parent enzyme. For example, as shown in the Figures, G2P has a 1.70 fold increase in thermostability improvement as compared to G1P: this is calculated by [(activity of variant)/(activity of parent)]. In many embodiments, the improvement is at least one and a tenth fold (1.1), one and a half fold (1.5 fold), 2 fold, 3 fold, 4 fold, 5 fold, 6 fold, 7 fold, 8 fold, 9 fold, or 10 fold or higher.

The variant glucoamylases of the invention can have an improvement one or more of a number of biochemical properties, including, but not limited to, pH activity, pH stability, thermostability, specific activity, activity and thermoactivity, formulation stability (including liquid, solid and pellets), performance in animals and/or animal feed and/or protease stability. In general, improvements are measured as compared to the G1P enzyme using a glucoamylase activity assay, as outlined below, under conditions that challenge the variant glucoamylase against the G1P enzyme.

A. Starch Assay to Determine Glucoamylase Activity and Thermoactivity

In some embodiments, a starch assay is employed to determine glucoamylase activity, such as the one described in the Examples section. Specifically, 150 µl of 1% corn starch in 0.1 M sodium acetate, pH 4.5 (final starch concentration of 0.75%) is added to 96 deep well plates. 15 µl-25 µl of enzyme from lysate plates is added to the starch reaction plates (see, for example, Example 1). The final volume is optionally adjusted to 200 µl using 0.1M sodium acetate buffer, pH 4.5. The plates are incubated at 40° C., 800 rpm for 24-72 hrs. At 24 and 72 hrs, the plates are centrifuged at 4000 rpm for 5 minutes and 20 µl of reaction supernatant is taken out into 96 well shallow microtiter plates and 180 µl of D-Glucose assay reagent (GOPOD assay kit from Megazyme, Catalogue # K-GLUC) is added to each well. The plates are then incubated at 50° C. for 30 minutes. Following the incubation, the plates are read at 510 nm to monitor glucose released due to breakdown of starch. Activity of a glucoamylase variant is compared to the parent glucoamylase enzyme under the same conditions to determine activity improvement. In some embodiments the parent glucoamylase enzyme is a polypeptide of SEQ ID NO:1.

B. Thermostability

In many embodiments, the variant glucoamylases of the invention have increased thermostability, particularly under the conditions used in starch processing, such as saccharification, as is more fully outlined below. Thermostability is also a consideration in the production of animal and human feeds, for example, which frequently use high temperatures during the pelleting process for periods of time that traditionally inactivate wild type glucoamylases. "Thermostability" in this context means that the variant enzymes are more stable than the parent glucoamylase (e.g. G1P) under the same thermal challenge conditions, that is, the activity of the variant is higher than that of the G1P under identical conditions (generally using the glucoamylase assay as outlined herein and as shown in Example 1).

A suitable thermostability assay is as follows. 50 µl of the enzymes from the lysate plates are added to 96 well Biorad PCR plates and are challenged at 57° C. (for G1), 59° C. (for G2), 62° C. (for G3), 67° C. (for G4) and 72° C. (for G5) in thermocyclers for 10 minutes. Following the 10 minutes incubation, 20 µl of the challenged lysate is added to 96 deep well starch reaction plates containing 150 µl of 2% corn starch in 0.1M sodium acetate, pH 4.5 (final starch concentration of 1.5%). The final volume is adjusted to 200 µl using 0.1M sodium acetate buffer, pH 4.5. The plates are incubated at 40° C., 800 rpm for 21-48 hrs. At 21-48 hrs, the plates are centrifuged at 4000 rpm for 5 minutes and 20 µl of reaction supernatant is taken out into 96 well shallow microtiter plates and 180 µl of D-Glucose assay reagent (GOPOD assay kit from Megazyme, Catalogue # K-GLUC) is added to each well. The plates are then incubated at 50° C. for 30 minutes. Following the incubation, the plates are read at 510 nm to monitor glucose released due to breakdown of starch. Activity of Glucoamylase variant is compared to the parent under the same conditions to determine thermo stability improvement.

In additional embodiments, when the enzyme is used in carbohydrate processing such as saccharification, the enzymes are generally more stable in the presence of the starch substrate. Thus, in these embodiments, the reactions are generally measured in days, with the variant glucoamylases showing signifciant stability at 24 hours, 48 hours and 72 hours at 60° C. in the presence of substrates as outlined below.

Taken together, the variant glucoamylases of the invention can exhibit increased thermostability as compared to SEQ ID NO:1 at 40° C., 45° C., 50° C., 55° C., 58° C., 60° C., 65° C., 66° C., 70° C., 75° C., 80° C. and/or 85° C. for a period of time, generally ranging from about 10 minutes to 72 hours, with 24, 45, 48 and 72 hours finding particular use in the invention.

Accordingly, as shown in the Figures, a number of variant glucoamylases of the invention exhibit increased thermostability.

C. pH Stability

In many embodiments, the variant glucoamylases of the invention have altered pH activity or stability as compared to the parent glucoamylase. "Increased pH stability" in this context means that the variant enzymes are more stable than the parent glucoamylase (e.g. G1P) under the same pH challenge conditions, that is, the activity of the variant is higher than that of the G1P under identical conditions (generally using the glucoamylase assay as outlined herein and as shown in Example 1). For example, starch processing can be done at a variety of pHs, depending on the raw substrates and reaction conditions D. Specific Activity Assays In some embodiments, the variant glucoamylases of the invention have increased specific activity as compared to a parent glucoamylase, particularly G1P. By "specific activity" herein is meant the activity per amount of enzyme, generally determined by dividing the enzymatic activity of a sample (sometimes measured in "glucoamylase units") by the amount of glucoamylase enzyme, generally determined as is known in the art.

E. Protease Susceptibility

In some embodiments, the variant glucoamylases of the invention are less susceptible to protease degradation than the parent enzyme under identical conditions. In some cases, protease degradation during the production of variant glucoamylases in a production host organism by protease enzymes produced by the host organism can be a problem, thus resulting in lower yield of active enzyme. Similarly, depending on the use of the variant enzymes, for example in starch processing, there may be other proteases present in the raw substrates or other enzymes for use in combination that can degrade the glucoamylase during the starch processing.

This is generally determined as is known in the art, for example by allowing proteolytic degradation and then doing N-terminal sequencing on the resulting fragments to determine the cleavage site(s). In some cases, depending on the variant and the host production organism, there may not be significant proteolytic degradation.

As needed, as will be appreciated by those in the art, the specific mutations that can be made will depend on the endogenous proteases that the host organism produces, and also generally occurs in surface exposed loop structures or turns that are therefore accessible to proteases. For example, production of glucoamylases in *A. niger* fungal production organisms can lead to proteolytic degradation; see Wyss et al., Appl. And Environ. Microbiol. February 1999:359-366, hereby incorporated by reference in its entirety.

V. Specific Variant Glucoamylases

The present invention provides variant glucoamylase enzymes comprising an amino acid substitution at one or more (e.g., several) positions corresponding to positions 14, 23, 30, 31, 35, 36, 39, 44, 49, 50, 51, 53, 69, 83, 98, 111, 117, 118, 119, 121, 147, 157, 179, 186, 197, 250, 262, 284, 286, 287, 288, 300, 309, 311, 317, 347, 362, 385, 388, 400, 413, 415, 419, 423, 434, 457, 463, 516, 526, 530, 533, 534, 535, 540, 545, 547, 553, 555, 564, 572, 576, 577, 581, 583, 585 and 588 as compared to a parent glucoamylase enzyme. In some embodiments, the parent glucoamylase enzyme is SEQ ID NO:1. In some embodiments, the variant has at least 75%, at least 80%, at least 85%, at least 90%, at least 95%, at least 96%, at least 97%, at least 98%, or at least 99%, but less than 100% sequence identity to the polypeptide of SEQ ID NO: 1. To be clear, the variant glucoamylases of the invention do not have SEQ ID NO:1.

In some embodiments, the variant glucoamylase enzymes comprise one or more (e.g., several) substitutions selected from the group consisting of S14Q, K23N, K23R, K23Y, S30D, S30N, S30P, T31E, T31K, T31N, T31Q, A35L, S36R, S39A, L44I, T49K, T49R, S50E, S50I, S50N, S50Y, N51D, D53N, I69L, I69M, E83K, T98S, A111G, A117P, A117V, D118N, L119M, Q121A, Q121P, Y147W, C157W, Y179F, P186Y, Y197H, S250D, S250E, S250K, A262S, Q284H, I286A, T287N, T288H, A300L, A300Q, T309D, T309E, T309Q, L311V, A317K, L347K, T362A, S385L, S385Q, T388I, T388K, T388Y, T400K, N413S, A415D, A415F, A415N, A415S, A415T, A415W, A415Y, Q419P, Q423M, Q423P, S434T, G457N, G457P, T463F, F516L, L526F, S530E, S530G, T533K, A534L, S535E, S535G, S535K, S535T, T540A, T540S, V545L, Q547A, Q547H, F553Y, F555Y, I564F, K572E, V576I, V576L, G577R, T581I, T581K, V583F, V585P and S588Q.

In some embodiments, the variant glucoamylase enzymes comprise one or more variants selected from FIG. 10.

In some embodiments, the variant glucoamylase enzyme is an isolated variant glucoamylase enzyme.

In some embodiments, the variant glucoamylase enzymes exhibits at least 85%, at least 90%, at least 91%, at least 92%, at least 93%, at least 94%, at least 95%, at least 96%, at least 97%, at least 98%, or at least 99%, but less than 100%, sequence identity to the amino acid sequence of the parent glucoamylase.

In some embodiments, the variant glucoamylase enzymes exhibits at least 85%, at least 90%, at least 91%, at least 92%, at least 93%, at least 94%, at least 95%, at least 96%, at least 97%, at least 98%, or at least 99%, but less than 100%, sequence identity to the amino acid sequence of the parent glucoamylase, SEQ ID NO:1.

In some embodiments, the variant glucoamylase enzyme comprises at least one substitution at a position selected from the group consisting of 14, 23, 30, 31, 35, 36, 39, 44, 49, 50, 51, 53, 69, 83, 98, 111, 117, 118, 119, 121, 147, 157, 179, 186, 197, 250, 262, 284, 286, 287, 288, 300, 309, 311, 317, 347, 362, 385, 388, 400, 413, 415, 419, 423, 434, 457, 463, 516, 526, 530, 533, 534, 535, 540, 545, 547, 553, 555, 564, 572, 576, 577, 581, 583, 585 and 588. In some cases, the variant enzyme can comprise 1, 2, 3, 4, 5, 6, 7, 8, 9, 10, 11, 12, 13, 14, 15, 16, 17, 18, 19 or 20 amino acid substitutions at these positions, with from 1 to 10, 1 to 9, 1 to 8, 1 to 7, 1 to 6, 1 to 5, 1 to 4, 1 to 3, 1 to 2 or a single substitution finding particular use in the invention.

In some embodiments, the variant glucoamylase enzyme comprises at least one substitution at a position selected from the group consisting of S14Q, K23N, K23R, K23Y, S30D, S30N, S30P, T31E, T31K, T31N, T31Q, A35L, S36R, S39A, L44I, T49K, T49R, S50E, S50I, S50N, S50Y, N51D, D53N, I69L, I69M, E83K, T98S, A111G, A117P, A117V, D118N, L119M, Q121A, Q121P, Y147W, C157W, Y179F, P186Y, Y197H, S250D, S250E, S250K, A262S, Q284H, I286A, T287N, T288H, A300L, A300Q, T309D, T309E, T309Q, L311V, A317K, L347K, T362A, S385L, S385Q, T388I, T388K, T388Y, T400K, N413S, A415D, A415F, A415N, A415S, A415T, A415W, A415Y, Q419P, Q423M, Q423P, S434T, G457N, G457P, T463F, F516L, L526F, S530E, S530G, T533K, A534L, S535E, S535G, S535K, S535T, T540A, T540S, V545L, Q547A, Q547H, F553Y, F555Y, I564F, K572E, V576I, V576L, G577R, T581I, T581K, V583F, V585P and S588Q. In some cases, the variant enzyme can comprise 1, 2, 3, 4, 5, 6, 7, 8, 9, 10, 11, 12, 13, 14, 15, 16, 17, 18, 19 or 20 amino acid substitutions at these positions, with from 1 to 10, 1 to 9, 1 to 8, 1 to 7, 1 to 6, 1 to 5, 1 to 4, 1 to 3, 1 to 2 or a single substitution finding particular use in the invention.

In some embodiments, the variant glucoamylase enzyme comprises an amino acid substitution of the serine at position 14. In some embodiments, the substitution is with any other of the 19 naturally occurring amino acids, namely glutamine, lysine, threonine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is S14Q.

In some embodiments, the variant glucoamylase enzyme comprises an amino acid substitution of the lysine at position 23. In some embodiments, the substitution is with any other of the 19 naturally occurring amino acids, namely glutamine, serine, threonine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of S23N, S23R and S23Y.

In some embodiments, the variant glucoamylase enzyme comprises an amino acid substitution of the serine at position 30. In some embodiments, the substitution is with any other of the 19 naturally occurring amino acids, namely lysine, glutamine, threonine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of S30D, S30N and S30P.

In some embodiments, the variant glucoamylase enzyme comprises an amino acid substitution of the threonine at position 31. In some embodiments, the substitution is with any other of the 19 naturally occurring amino acids, namely lysine, glutamine, serine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of T31E, T31K, T31N and T31Q.

In some embodiments, the variant glucoamylase enzyme comprises an amino acid substitution of the alanine at position 35. In some embodiments, the substitution is with any other of the 19 naturally occurring amino acids, namely lysine, glutamine, serine, threonine, asparagine, arginine, histidine, glutamic acid, aspartic acid, cysteine, glycine, proline, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is A35L.

In some embodiments, the variant glucoamylase enzyme comprises an amino acid substitution of the serine at position 36. In some embodiments, the substitution is with any other of the 19 naturally occurring amino acids, namely lysine, glutamine, threonine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is S36R.

In some embodiments, the variant glucoamylase enzyme comprises an amino acid substitution of the serine at position 39. In some embodiments, the substitution is with any other of the 19 naturally occurring amino acids, namely lysine, glutamine, threonine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is S39A.

In some embodiments, the variant glucoamylase enzyme comprises an amino acid substitution of the leucine at position 44. In some embodiments, the substitution is with any other of the 19 naturally occurring amino acids, namely lysine, glutamine, serine, threonine, asparagine, arginine, histidine, glutamic acid, aspartic acid, cysteine, glycine, proline, alanine, isoleucine, methionine, phenylalanine, tryptophan, valine and tyrosine, with some embodiments not utilizing cysteine (due to possible disulfide formation) or proline (due to steric effects). In some embodiments, the amino acid substitution is L44I.

In some embodiments, the variant glucoamylase enzyme comprises an amino acid substitution of the threonine at position 49. In some embodiments, the substitution is with any other of the 19 naturally occurring amino acids, namely lysine, glutamine, serine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of T49K and T49R.

In some embodiments, the variant glucoamylase enzyme comprises an amino acid substitution of the serine at position 50. In some embodiments, the substitution is with any other of the 19 naturally occurring amino acids, namely lysine, glutamine, threonine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of S50E, S50I, S50N and S50Y.

In some embodiments, the variant glucoamylase enzyme comprises an amino acid substitution of the asparagine at position 51. In some embodiments, the substitution is with any other of the 19 naturally occurring amino acids, namely lysine, glutamine, serine, threonine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is N51D.

In some embodiments, the variant glucoamylase enzyme comprises an amino acid substitution of the aspartic acid at position 53. In some embodiments, the substitution is with any other of the 19 naturally occurring amino acids, namely lysine, glutamine, serine, threonine, asparagine, arginine, histidine, glutamic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is D53N.

In some embodiments, the variant glucoamylase enzyme comprises an amino acid substitution of the isoleucine at position 69. In some embodiments, the substitution is with any other of the 19 naturally occurring amino acids, namely lysine, glutamine, serine, threonine, asparagine, arginine, histidine, glutamic acid, aspartic acid, cysteine, glycine, proline, alanine, leucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of I69L and I69M.

In some embodiments, the variant glucoamylase enzyme comprises an amino acid substitution of the glutamic acid at position 83. In some embodiments, the substitution is with any other of the 19 naturally occurring amino acids, namely lysine, isoleucine, glutamine, serine, threonine, asparagine, arginine, histidine, aspartic acid, cysteine, glycine, proline, alanine, leucine, methionine, phenylalanine, tryptophan, valine and tyrosine, with some embodiments not utilizing cysteine (due to possible disulfide formation) or proline (due to steric effects). In some embodiments, the amino acid substitution is E83K.

In some embodiments, the variant glucoamylase enzyme comprises an amino acid substitution of the threonine at position 98. In some embodiments, the substitution is with any other of the 19 naturally occurring amino acids, namely lysine, glutamine, serine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is T98S.

In some embodiments, the variant glucoamylase enzyme comprises an amino acid substitution of the alanine at position 111. In some embodiments, the substitution is with any other of the 19 naturally occurring amino acids, namely lysine, glutamine, serine, threonine, asparagine, arginine, histidine, glutamic acid, aspartic acid, cysteine, glycine, proline, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is A111G.

In some embodiments, the variant glucoamylase enzyme comprises an amino acid substitution of the alanine at position 117. In some embodiments, the substitution is with any other of the 19 naturally occurring amino acids, namely lysine, glutamine, serine, threonine, asparagine, arginine, histidine, glutamic acid, aspartic acid, cysteine, glycine, proline, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of A117P and A117V.

In some embodiments, the variant glucoamylase enzyme comprises an amino acid substitution of the aspartic acid at position 118. In some embodiments, the substitution is with any other of the 19 naturally occurring amino acids, namely lysine, glutamine, serine, threonine, asparagine, arginine, histidine, glutamic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is D118N.

In some embodiments, the variant glucoamylase enzyme comprises an amino acid substitution of the leucine at position 119. In some embodiments, the substitution is with any other of the 19 naturally occurring amino acids, namely lysine, glutamine, serine, threonine, asparagine, arginine, histidine, glutamic acid, aspartic acid, cysteine, glycine, proline, alanine, isoleucine, methionine, phenylalanine, tryptophan, valine and tyrosine, with some embodiments not utilizing cysteine (due to possible disulfide formation) or proline (due to steric effects). In some embodiments, the amino acid substitution is L119M.

In some embodiments, the variant glucoamylase enzyme comprises an amino acid substitution of the glutamine at position 121. In some embodiments, the substitution is with any other of the 19 naturally occurring amino acids, namely lysine, serine, threonine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of Q121A and Q121P.

In some embodiments, the variant glucoamylase enzyme comprises an amino acid substitution of the tyrosine at position 147. In some embodiments, the substitution is with any other of the 19 naturally occurring amino acids, namely lysine, glutamine, serine, threonine, asparagine, arginine, histidine, glutamic acid, aspartic acid, cysteine, glycine, proline, alanine, isoleucine, leucine, methionine, phenylalanine, tryptophan and valine, with some embodiments not utilizing cysteine (due to possible disulfide formation) or proline (due to steric effects). In some embodiments, the amino acid substitution is Y147W.

In some embodiments, the variant glucoamylase enzyme comprises an amino acid substitution of the cysteine at position 157. In some embodiments, the substitution is with any other of the 19 naturally occurring amino acids, namely lysine, glutamine, serine, threonine, asparagine, arginine, histidine, glutamic acid, aspartic acid, tyrosine, glycine, proline, alanine, isoleucine, leucine, methionine, phenylalanine, tryptophan and valine, with some embodiments not utilizing cysteine (due to possible disulfide formation) or proline (due to steric effects). In some embodiments, the amino acid substitution is C157W.

In some embodiments, the variant glucoamylase enzyme comprises an amino acid substitution of the tyrosine at position 179. In some embodiments, the substitution is with any other of the 19 naturally occurring amino acids, namely lysine, glutamine, serine, threonine, asparagine, arginine, histidine, glutamic acid, aspartic acid, cysteine, glycine, proline, alanine, isoleucine, leucine, methionine, phenylalanine, tryptophan and valine, with some embodiments not utilizing cysteine (due to possible disulfide formation) or proline (due to steric effects). In some embodiments, the amino acid substitution is Y179F.

In some embodiments, the variant glucoamylase enzyme comprises an amino acid substitution of the proline at position 186. In some embodiments, the substitution is with any other of the 19 naturally occurring amino acids, namely lysine, glutamine, serine, threonine, asparagine, arginine, histidine, glutamic acid, aspartic acid, cysteine, glycine, tyrosine, alanine, isoleucine, leucine, methionine, phenylalanine, tryptophan and valine, with some embodiments not utilizing cysteine (due to possible disulfide formation) or proline (due to steric effects). In some embodiments, the amino acid substitution is P186Y.

In some embodiments, the variant glucoamylase enzyme comprises an amino acid substitution of the tyrosine at position 197. In some embodiments, the substitution is with any other of the 19 naturally occurring amino acids, namely lysine, glutamine, serine, threonine, asparagine, arginine, histidine, glutamic acid, aspartic acid, cysteine, glycine, proline, alanine, isoleucine, leucine, methionine, phenylalanine, tryptophan and valine, with some embodiments not utilizing cysteine (due to possible disulfide formation) or proline (due to steric effects). In some embodiments, the amino acid substitution is Y197H.

In some embodiments, the variant glucoamylase enzyme comprises an amino acid substitution of the serine at position 250. In some embodiments, the substitution is with any other of the 19 naturally occurring amino acids, namely lysine, glutamine, tyrosine, threonine, asparagine, arginine, histidine, glutamic acid, aspartic acid, cysteine, glycine, proline, alanine, isoleucine, leucine, methionine, phenylalanine, tryptophan and valine, with some embodiments not utilizing cysteine (due to possible disulfide formation) or proline (due to steric effects). In some embodiments, the amino acid substitution is selected from the group consisting of S250D, S250E and S250K.

In some embodiments, the variant glucoamylase enzyme comprises an amino acid substitution of the alanine at position 262. In some embodiments, the substitution is with any other of the 19 naturally occurring amino acids, namely lysine, glutamine, serine, threonine, asparagine, arginine, histidine, glutamic acid, aspartic acid, cysteine, glycine, proline, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is A262S.

In some embodiments, the variant glucoamylase enzyme comprises an amino acid substitution of the glutamine at position 284. In some embodiments, the substitution is with any other of the 19 naturally occurring amino acids, namely lysine, serine, threonine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is Q284H.

In some embodiments, the variant glucoamylase enzyme comprises an amino acid substitution of the isoleucine at position 286. In some embodiments, the substitution is with any other of the 19 naturally occurring amino acids, namely lysine, glutamine, serine, threonine, asparagine, arginine, histidine, glutamic acid, aspartic acid, cysteine, glycine, proline, alanine, leucine, methionine, phenylalanine, tryptophan, valine and tyrosine, with some embodiments not utilizing cysteine (due to possible disulfide formation) or proline (due to steric effects). In some embodiments, the amino acid substitution is I286A.

In some embodiments, the variant glucoamylase enzyme comprises an amino acid substitution of the threonine at position 287. In some embodiments, the substitution is with any other of the 19 naturally occurring amino acids, namely lysine, glutamine, serine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is T287N.

In some embodiments, the variant glucoamylase enzyme comprises an amino acid substitution of the threonine at position 288. In some embodiments, the substitution is with any other of the 19 naturally occurring amino acids, namely lysine, glutamine, serine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is T288H.

In some embodiments, the variant glucoamylase enzyme comprises an amino acid substitution of the alanine at position 300. In some embodiments, the substitution is with any other of the 19 naturally occurring amino acids, namely lysine, glutamine, serine, asparagine, arginine, histidine, glutamic acid, aspartic acid, cysteine, glycine, proline, threonine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of A300L and A300Q.

In some embodiments, the variant glucoamylase enzyme comprises an amino acid substitution of the threonine at position 309. In some embodiments, the substitution is with any other of the 19 naturally occurring amino acids, namely lysine, glutamine, serine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of T309D, T309E and T309Q.

In some embodiments, the variant glucoamylase enzyme comprises an amino acid substitution of the leucine at position 311. In some embodiments, the substitution is with any other of the 19 naturally occurring amino acids, namely lysine, glutamine, threonine, serine, asparagine, arginine, histidine, glutamic acid, aspartic acid, cysteine, glycine, proline, alanine, isoleucine, methionine, phenylalanine, tryptophan, valine and tyrosine, with some embodiments not utilizing cysteine (due to possible disulfide formation) or proline (due to steric effects). In some embodiments, the amino acid substitution is L311V.

In some embodiments, the variant glucoamylase enzyme comprises an amino acid substitution of the leucine at position 317. In some embodiments, the substitution is with any other of the 19 naturally occurring amino acids, namely lysine, glutamine, threonine, serine, asparagine, arginine, histidine, glutamic acid, aspartic acid, cysteine, glycine, proline, alanine, isoleucine, methionine, phenylalanine, tryptophan, valine and tyrosine, with some embodiments not utilizing cysteine (due to possible disulfide formation) or proline (due to steric effects). In some embodiments, the amino acid substitution is A317K.

In some embodiments, the variant glucoamylase enzyme comprises an amino acid substitution of the leucine at position 347. In some embodiments, the substitution is with any other of the 19 naturally occurring amino acids, namely lysine, glutamine, threonine, serine, asparagine, arginine, histidine, glutamic acid, aspartic acid, cysteine, glycine, proline, alanine, isoleucine, methionine, phenylalanine, tryptophan, valine and tyrosine, with some embodiments not utilizing cysteine (due to possible disulfide formation) or proline (due to steric effects). In some embodiments, the amino acid substitution is L347K.

In some embodiments, the variant glucoamylase enzyme comprises an amino acid substitution of the leucine at position 362. In some embodiments, the substitution is with any other of the 19 naturally occurring amino acids, namely lysine, glutamine, threonine, serine, asparagine, arginine, histidine, glutamic acid, aspartic acid, cysteine, glycine, proline, alanine, isoleucine, methionine, phenylalanine, tryptophan, valine and tyrosine, with some embodiments not utilizing cysteine (due to possible disulfide formation) or proline (due to steric effects). In some embodiments, the amino acid substitution is T362A.

In some embodiments, the variant glucoamylase enzyme comprises an amino acid substitution of the leucine at position 385. In some embodiments, the substitution is with any other of the 19 naturally occurring amino acids, namely lysine, glutamine, threonine, serine, asparagine, arginine, histidine, glutamic acid, aspartic acid, cysteine, glycine, proline, alanine, isoleucine, methionine, phenylalanine, tryptophan, valine and tyrosine, with some embodiments not utilizing cysteine (due to possible disulfide formation) or proline (due to steric effects). In some embodiments, the amino acid substitution is S385L and S385Q.

In some embodiments, the variant glucoamylase enzyme comprises an amino acid substitution of the threonine at position 388. In some embodiments, the substitution is with any other of the 19 naturally occurring amino acids, namely lysine, glutamine, leucine, serine, asparagine, arginine, histidine, glutamic acid, aspartic acid, cysteine, glycine, proline, alanine, isoleucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of T388I, T388K and T388Y.

In some embodiments, the variant glucoamylase enzyme comprises an amino acid substitution of the threonine at position 400. In some embodiments, the substitution is with any other of the 19 naturally occurring amino acids, namely lysine, glutamine, leucine, serine, asparagine, arginine, histidine, glutamic acid, aspartic acid, cysteine, glycine, proline, alanine, isoleucine, methionine, phenylalanine, tryptophan, valine and tyrosine, with some embodiments not utilizing cysteine (due to possible disulfide formation) or proline (due to steric effects). In some embodiments, the amino acid substitution is T400K.

In some embodiments, the variant glucoamylase enzyme comprises an amino acid substitution of the aspartic acid at position 413. In some embodiments, the substitution is with any other of the 19 naturally occurring amino acids, namely lysine, glutamine, leucine, serine, asparagine, arginine, histidine, glutamic acid, threonine, cysteine, glycine, proline, alanine, isoleucine, methionine, phenylalanine, tryptophan, valine and tyrosine, with some embodiments not utilizing cysteine (due to possible disulfide formation) or proline (due to steric effects). In some embodiments, the amino acid substitution is N413S.

In some embodiments, the variant glucoamylase enzyme comprises an amino acid substitution of the alanine at position 415. In some embodiments, the substitution is with any other of the 19 naturally occurring amino acids, namely lysine, glutamine, leucine, serine, asparagine, arginine, histidine, glutamic acid, aspartic acid, cysteine, glycine, proline, threonine, isoleucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of A415D, A415F, A415N, A415S, A415T, A415W and A415Y.

In some embodiments, the variant glucoamylase enzyme comprises an amino acid substitution of the glutamine at position 419. In some embodiments, the substitution is with any other of the 19 naturally occurring amino acids, namely lysine, serine, threonine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is Q419P.

In some embodiments, the variant glucoamylase enzyme comprises an amino acid substitution of the glutamine at position 423. In some embodiments, the substitution is with any other of the 19 naturally occurring amino acids, namely lysine, serine, threonine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of Q423M and Q423P.

In some embodiments, the variant glucoamylase enzyme comprises an amino acid substitution of the serine at position 434. In some embodiments, the substitution is with any other of the 19 naturally occurring amino acids, namely lysine, glutamine, threonine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is S434T.

In some embodiments, the variant glucoamylase enzyme comprises an amino acid substitution of the glycine at position 457. In some embodiments, the substitution is with any other of the 19 naturally occurring amino acids, namely lysine, glutamine, threonine, asparagine, arginine, histidine, glutamic acid, aspartic acid, cysteine, serine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of G457N and G457P.

In some embodiments, the variant glucoamylase enzyme comprises an amino acid substitution of the threonine at position 463. In some embodiments, the substitution is with any other of the 19 naturally occurring amino acids, namely lysine, serine, glutamine, phenylalanine, asparagine, arginine, histidine, glutamic acid, aspartic acid, cysteine, glycine, proline, alanine, isoleucine, leucine, methionine, tryptophan, valine and tyrosine, with some embodiments not utilizing cysteine (due to possible disulfide formation) or proline (due to steric effects). In some embodiments, the amino acid substitution is T463F.

In some embodiments, the variant glucoamylase enzyme comprises an amino acid substitution of the phenylalanine at position 516. In some embodiments, the substitution is with any other of the 19 naturally occurring amino acids, namely lysine, serine, glutamine, threonine, asparagine, arginine, histidine, glutamic acid, aspartic acid, cysteine, glycine, proline, alanine, isoleucine, leucine, methionine, tryptophan, valine and tyrosine, with some embodiments not utilizing cysteine (due to possible disulfide formation) or proline (due to steric effects). In some embodiments, the amino acid substitution is F516L.

In some embodiments, the variant glucoamylase enzyme comprises an amino acid substitution of the leucine at position 526. In some embodiments, the substitution is with any other of the 19 naturally occurring amino acids, namely lysine, serine, glutamine, threonine, asparagine, arginine, histidine, glutamic acid, aspartic acid, cysteine, glycine, proline, alanine, isoleucine, phenylalanine, methionine, tryptophan, valine and tyrosine, with some embodiments not utilizing cysteine (due to possible disulfide formation) or proline (due to steric effects). In some embodiments, the amino acid substitution is L526F.

In some embodiments, the variant glucoamylase enzyme comprises an amino acid substitution of the serine at position 530. In some embodiments, the substitution is with any other of the 19 naturally occurring amino acids, namely lysine, glutamine, threonine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of S530E and S530G.

In some embodiments, the variant glucoamylase enzyme comprises an amino acid substitution of the threonine at position 533. In some embodiments, the substitution is with any other of the 19 naturally occurring amino acids, namely lysine, serine, glutamine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is T533K.

In some embodiments, the variant glucoamylase enzyme comprises an amino acid substitution of the alanine at position 534. In some embodiments, the substitution is with any other of the 19 naturally occurring amino acids, namely lysine, serine, glutamine, threonine, asparagine, arginine, histidine, glutamic acid, aspartic acid, cysteine, glycine, proline, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is A534L.

In some embodiments, the variant glucoamylase enzyme comprises an amino acid substitution of the serine at position 535. In some embodiments, the substitution is with any other of the 19 naturally occurring amino acids, namely lysine, glutamine, threonine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of S535E, S535G, S535K and S535T.

In some embodiments, the variant glucoamylase enzyme comprises an amino acid substitution of the threonine at position 540. In some embodiments, the substitution is with any other of the 19 naturally occurring amino acids, namely lysine, serine, glutamine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of T540A and T540S.

In some embodiments, the variant glucoamylase enzyme comprises an amino acid substitution of the valine at position 545. In some embodiments, the substitution is with any other of the 19 naturally occurring amino acids, namely lysine, serine, glutamine, threonine, asparagine, arginine, histidine, glutamic acid, aspartic acid, cysteine, glycine, proline, alanine, isoleucine, leucine, methionine, phenylalanine, tryptophan and tyrosine, with some embodiments not utilizing cysteine (due to possible disulfide formation) or proline (due to steric effects). In some embodiments, the amino acid substitution is V545L.

In some embodiments, the variant glucoamylase enzyme comprises an amino acid substitution of the glutamine at position 547. In some embodiments, the substitution is with any other of the 19 naturally occurring amino acids, namely lysine, serine, threonine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of Q547A and Q547H.

In some embodiments, the variant glucoamylase enzyme comprises an amino acid substitution of the phenylalanine at position 553. In some embodiments, the substitution is with any other of the 19 naturally occurring amino acids, namely lysine, serine, glutamine, threonine, asparagine, arginine, histidine, glutamic acid, aspartic acid, cysteine, glycine, proline, alanine, isoleucine, leucine, methionine, tryptophan, valine and tyrosine, with some embodiments not utilizing cysteine (due to possible disulfide formation) or proline (due to steric effects). In some embodiments, the amino acid substitution is F553Y.

In some embodiments, the variant glucoamylase enzyme comprises an amino acid substitution of the phenylalanine at position 555. In some embodiments, the substitution is with any other of the 19 naturally occurring amino acids, namely lysine, serine, glutamine, threonine, asparagine, arginine, histidine, glutamic acid, aspartic acid, cysteine, glycine, proline, alanine, isoleucine, leucine, methionine, tryptophan, valine and tyrosine, with some embodiments not utilizing cysteine (due to possible disulfide formation) or proline (due to steric effects). In some embodiments, the amino acid substitution is F555Y.

In some embodiments, the variant glucoamylase enzyme comprises an amino acid substitution of the isoleucine at position 564. In some embodiments, the substitution is with any other of the 19 naturally occurring amino acids, namely lysine, serine, glutamine, threonine, asparagine, arginine, histidine, glutamic acid, aspartic acid, cysteine, glycine, proline, alanine, leucine, methionine, phenylalanine, tryptophan, valine and tyrosine, with some embodiments not utilizing cysteine (due to possible disulfide formation) or proline (due to steric effects). In some embodiments, the amino acid substitution is I564F.

In some embodiments, the variant glucoamylase enzyme comprises an amino acid substitution of the lysine at position 572. In some embodiments, the substitution is with any other of the 19 naturally occurring amino acids, namely serine, glutamine, threonine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is K572E.

In some embodiments, the variant glucoamylase enzyme comprises an amino acid substitution of the valine at position 576. In some embodiments, the substitution is with any other of the 19 naturally occurring amino acids, namely lysine, serine, glutamine, threonine, asparagine, arginine, histidine, glutamic acid, aspartic acid, cysteine, glycine, proline, alanine, isoleucine, leucine, methionine, phenylalanine, tryptophan and tyrosine, with some embodiments not utilizing cysteine (due to possible disulfide formation) or proline (due to steric effects). In some embodiments, the amino acid substitution is selected from the group consisting of V576I and V576L.

In some embodiments, the variant glucoamylase enzyme comprises an amino acid substitution of the glycine at position 577. In some embodiments, the substitution is with any other of the 19 naturally occurring amino acids, namely lysine, serine, glutamine, threonine, asparagine, arginine, histidine, glutamic acid, aspartic acid, cysteine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is G577R.

In some embodiments, the variant glucoamylase enzyme comprises an amino acid substitution of the threonine at position 581. In some embodiments, the substitution is with any other of the 19 naturally occurring amino acids, namely lysine, serine, glutamine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is selected from the group consisting of T581I and T581K.

In some embodiments, the variant glucoamylase enzyme comprises an amino acid substitution of the valine at position 583. In some embodiments, the substitution is with any other of the 19 naturally occurring amino acids, namely lysine, serine, glutamine, threonine, asparagine, arginine, histidine, glutamic acid, aspartic acid, cysteine, glycine, proline, alanine, isoleucine, leucine, methionine, phenylalanine, tryptophan and tyrosine, with some embodiments not utilizing cysteine (due to possible disulfide formation) or proline (due to steric effects). In some embodiments, the amino acid substitution is V583F.

In some embodiments, the variant glucoamylase enzyme comprises an amino acid substitution of the valine at position 585. In some embodiments, the substitution is with any other of the 19 naturally occurring amino acids, namely lysine, serine, glutamine, threonine, asparagine, arginine, histidine, glutamic acid, aspartic acid, cysteine, glycine, proline, alanine, isoleucine, leucine, methionine, phenylalanine, tryptophan and tyrosine, with some embodiments not utilizing cysteine (due to possible disulfide formation) or proline (due to steric effects). In some embodiments, the amino acid substitution is V585P.

In some embodiments, the variant glucoamylase enzyme comprises an amino acid substitution of the serine at position 588. In some embodiments, the substitution is with any other of the 19 naturally occurring amino acids, namely lysine, glutamine, threonine, asparagine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is S588Q.

In some embodiments, the variant glucoamylase enzyme comprises the G2P variant A111G.

In some embodiments, the variant enzymes of the invention comprise the amino acid substitution A111G and are at least 95%, 96%, 97%, 98% or 99% identical to SEQ ID NO:3. In some embodiments the variant enzyme is SEQ ID NO:3.

In some embodiments, the variant enzymes of the invention comprise the amino acid substitutions S30P/A111G and are at least 95%, 96%, 97%, 98% or 99% identical to SEQ ID NO:5. In some embodiments the variant enzyme is SEQ ID NO:5.

In some embodiments, the variant enzymes of the invention comprise the amino acid substitutions K23R/S30P/S39A/T49K/A111G/L119M/Q423P and are at least 95%, 96%, 97%, 98% or 99% identical to SEQ ID NO:207. In some embodiments the variant enzyme is SEQ ID NO:207.

In some embodiments, the variant enzymes of the invention comprise the amino acid substitutions K23R/S30P/S39A/L44I/T49R/N51D/A111G/A117V/L119M/N413S/Q423P and are at least 95%, 96%, 97%, 98% or 99% identical to SEQ ID NO:307. In some embodiments the variant enzyme is SEQ ID NO:307.

In some embodiments, the variant enzymes of the invention comprise the amino acid substitutions K23R/S30P/S39A/L44I/T49R/N51D/A111G/A117V/L119M/Q121P/T309D/A415Y/N413S/Q423P and are at least 95%, 96%, 97%, 98% or 99% identical to SEQ ID NO:361. In some embodiments the variant enzyme is SEQ ID NO:361.

Specific embodiments of suitable amino acid substitutions sets are those found in FIG. 3, as compared to SEQ ID NO:1.

Further specific embodiments of suitable amino acid substitution sets are those found in FIG. 4, made in the background of G2P, SEQ ID NO:3.

Further specific embodiments of suitable amino acid substitution sets are those found in FIG. 5, made in the background of G3P, SEQ ID NO:5

Further specific embodiments of suitable amino acid substitution sets are those found in FIG. 6, made in the background of G4P, SEQ ID NO:207.

Further specific embodiments of suitable amino acid substitution sets are those found in FIG. 7, made in the background of G5P, SEQ ID NO:307.

The amino acid changes that may be present in addition to the specific substitutions described herein may be of a minor nature, that is conservative amino acid substitutions or insertions that do not significantly affect the folding and/or activity of the protein; small deletions, typically of 1 to about 30 amino acids; small amino- or carboxyl-terminal extensions, such as an amino-terminal methionine residue; a small linker peptide of up to about 20 to about 25 residues; or a small extension that facilitates purification by changing net charge or another function, such as a poly-histidine tract, an antigenic epitope or a binding domain.

Examples of conservative substitutions are within the groups of basic amino acids (arginine, lysine and histidine), acidic amino acids (glutamic acid and aspartic acid), polar amino acids (glutamine and asparagine), hydrophobic amino acids (leucine, isoleucine and valine), aromatic amino acids (phenylalanine, tryptophan and tyrosine), and small amino acids (glycine, alanine, serine, threonine and methionine). Amino acid substitutions that do not generally alter specific activity are known in the art and are described, for example, by H. Neurath and R. L. Hill, 1979, In, *The Proteins*, Academic Press, New York. Common substitutions are Ala/Ser, Val/Ile, Asp/Glu, Thr/Ser, Ala/Gly, Ala/Thr, Ser/Asn, Ala/Val, Ser/Gly, Tyr/Phe, Ala/Pro, Lys/Arg, Asp/Asn, Leu/Ile, LeuA al, Ala/Glu, and Asp/Gly.

A. Parent Glucoamylase

The parent glucoamylase enzyme may be (a) a polypeptide having at least 85% sequence identity to the polypeptide of SEQ ID NO:1; (b) a polypeptide encoded by a polynucleotide that hybridizes under medium-high stringency conditions with (i) the mature polypeptide coding sequence of SEQ ID NO: 2, or (ii) the full-length complement of (i); or (c) a polypeptide encoded by a polynucleotide having at least 70% sequence identity to the mature polypeptide coding sequence of SEQ ID NO: 2. For hybridization methods and conditions, see for example, Sambrook et al., 1989, Molecular Cloning, A Laboratory Manual, 2d edition, Cold Spring Harbor, N.Y.

In some embodiments, the parent glucoamylase enzyme has a sequence identity to the polypeptide of SEQ ID NO: 1 of at least 85%, at least 90%, at least 91%, at least 92%, at least 93%, at least 94%, at least 95%, at least 96%, at least 97%, at least 98%, at least 99%, or 100%, and have glucoamylase activity. In one aspect, the amino acid sequence of the parent differs by up to 10 amino acids, e.g., 1, 2, 3, 4, 5, 6, 7, 8, 9, or 10, from the mature polypeptide of SEQ ID NO: 1.

In some embodiments, the parent glucoamylase enzyme is encoded by a polynucleotide having a sequence identity to the mature polypeptide coding sequence of SEQ ID NO:2 of at least 70%, at least 75%, at least 80%, at least 85%, at least 90%, at least 91%, at least 92%, at least 93%, at least 94%, at least 95%, at least 96%, at least 97%, at least 98%, at least 99%, or 100%.

In some embodiments, the parent glucoamylase enzyme is a *Thielaviopsis punctuala* glucoamylase, e.g., the glucoamylase of SEQ ID NO:1.

In one embodiment, the variant glucoamylase enzymes are more stable than the parent variant glucoamylase enzyme when exposed to temperatures of 40° C., 45° C., 50° C., 52° C., 55° C., 56° C., 58° C., 60° C., 65° C., 66° C., 70° C., 75° C., 80° C. and/or 85° C. for a period of time, generally ranging from about 1, 2, 3, 4, 5, 6, 7, 8, 9 or 10 minutes or longer, depending on the ultimate conditions for the use of the variant glucoamylase enzyme, with some embodiments utilizing thermal challenge times of 5 minutes to 10 minutes, 5 minutes to 15 minutes, 5 minutes to 60 minutes, 10 minutes to 60 minutes all finding use in the present invention. In some embodiments, a challenge of 85° C. and 5 minutes is used.

Accordingly, in some embodiments the variant glucoamylase enzymes have increased thermostability as compared to a parent variant glucoamylase enzyme, particularly G1P, for at least 5 minutes at 50° C., at least 5-10 minutes at 52° C., at least 5-10 minutes at 55° C., at least 5-10 minutes at 58° C., at least 5-10 minutes at 56° C., at least 5-10 minutes at 60° C., at least 5-10 minutes at 66° C. and in some embodiments at least 5-10 minutes at 70° C.

In addition, pH can be a consideration for thermostability as well. Accordingly, in some embodiments the variant glucoamylase enzymes have increased thermostability as compared to a parent glucoamylase enzyme for at least 5 minutes at 52° C. at pH 4.5, or at least 5 minutes at 56° C. at pH 4.5. Accordingly, in some embodiments the variant glucoamylase enzymes have increased thermostability as compared to a parent glucoamylase enzyme for at least 10 minutes at 52° C. at pH 4.5, or at least 10 minutes at 56° C. at pH 4.5.

Accordingly, as shown in FIGS. 3-7, a number of variant glucoamylase enzymes of the invention exhibit increased thermostability.

B. Nucleic Acid Compositions

The present invention also provides compositions comprising a variant glucoamylase enzyme encoding nucleic acid of the present invention. Such variant glucoamylase polyepepide encoding nucleic acids can encode any of the variant glucoamylase enzymes recited in the present application, including under section "C. Variant Glucoamylases" above. In some embodiments, the composition comprises a nucleic acid selected from the group consisting of the even numbered sequences in SEQ ID NOs: 2 to 362.

In some embodiments, the composition comprises a nucleic acid of SEQ ID NO:2. In some embodiments, the composition comprises a nucleic acid of SEQ ID NO:4. In some embodiments, the composition comprises a nucleic acid of SEQ ID NO:6. In some embodiments, the composition comprises a nucleic acid of SEQ ID NO:208. In some embodiments, the composition comprises a nucleic acid of SEQ ID NO:308. In some embodiments, the composition comprises a nucleic acid of SEQ ID NO:362.

In some embodiments, the variant glucoamylase enzyme encoding nucleic acid comprises a codon optimized version or variant of any of SEQ ID NOs 2 to 362.

"Codon optimized" in this context is done in relation to a particular host organism and its generally preferred amino acid codons; that is, the host production organism, e.g. an *Aspergillus* species, may yield higher translation and/or secretion using *Aspergillus* preferred codons as compared to a yeast production organism.

In some embodiments, the compositions are enriched in such a variant glucoamylase enzyme encoding nucleic acid of the present invention. The term "enriched" indicates that the glucoamylase activity capable of being obtained from the composition has been increased, e.g., with an enrichment factor of at least 1. In some embodiments, the compositions are formulated to provide desirable characteristics such as low color, low odor and acceptable storage stability.

1. Preparation of Variants

The variants can be prepared generally by construction genes encoding the protein sequence using well known techniques, including site-directed mutagenesis of a parental gene and synthetic gene construction.

i. Regulatory Sequences

The present invention also relates to nucleic acid constructs comprising a polynucleotide encoding a variant of the present invention operably linked to one or more control sequences that direct the expression of the coding sequence in a suitable host cell under conditions compatible with the control sequences. The control sequence may include a promoter, a polynucleotide which is recognized by a host cell for expression of the polynucleotide. The promoter contains transcriptional control sequences that mediate the expression of the variant. The promoter may be any polynucleotide that shows transcriptional activity in the host cell including mutant, truncated, and hybrid promoters, and may be obtained from genes encoding extracellular or intracellular polypeptides either homologous or heterologous to the host cell.

Examples of suitable promoters for directing transcription of the nucleic acid constructs of the present invention in a filamentous fungal host cell are promoters obtained from *Aspergillus* species genes, as is known in the art, including *A. nidulans*, *A. niger* and *A. oryzae*, as well as *Rhizomucor* species genes such as *R. miehei*, *Trichoderma* species genes including *T. reesei*, *Fusarium* species genes including *F. venenatum*. Yeast control sequences including promoters are also well known from *Saccharomyces cerevisiae*.

Suitable promoter sequences (as well as other control sequences) from these species include the promoters from amylases (α-amylase in particular), glucoamylases, proteases, phosphatases, endoglucanases, cellulases, etc. as are known in the art. In addition, as for codon-optimization, it may be desirable to use promoters (and other control sequences) that are endogeneous to the host production strain, operably linked to the nucleic acids encoding the variant glucoamylases. In many embodiments, the promoter that is operably attached to the coding sequence is not the native *Thielaviopsis punctuala* promoter sequence, found within SEQ ID NO:147.

The control sequence may also be a transcription terminator, which is recognized by a host cell to terminate transcription. The terminator sequence is operably linked to the 3'-terminus of the polynucleotide encoding the variant. Any terminator that is functional in the host cell can be used.

In some embodiments, terminators (and other control sequences such as promoters) for filamentous fungal host cells are obtained from the genes for *Aspergillus nidulans* anthranilate synthase, *Aspergillus niger* glucoamylase, *Aspergillus niger* alpha-glucosidase, *Aspergillus oryzae* TAKA amylase, and *Fusarium oxysporum* trypsin-like protease.

In some embodiments, terminators for yeast host cells are obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase.

The control sequence can also be an mRNA stabilizer region downstream of a promoter and upstream of the coding sequence of a gene which increases expression of the gene.

Examples of suitable mRNA stabilizer regions are obtained from a *Bacillus thuringiensis* cryIIIA gene (WO 94/25612) and a *Bacillus subtilis* SP82 gene (Hue et al., 1995, *Journal of Bacteriology* 177: 3465-3471).

The control sequence can also be a leader, a nontranslated region of an mRNA that is important for translation by the host cell. The leader sequence is operably linked to the 5'-terminus of the polynucleotide encoding the variant. Any leader that is functional in the host cell may be used.

In some embodiments, leaders for filamentous fungal host cells are obtained from the genes for *Aspergillus oryzae* TAKA amylase and *Aspergillus nidulans* triose phosphate isomerase.

In some embodiments, suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence can also be a polyadenylation sequence, a sequence operably linked to the 3'-terminus of the variant-encoding sequence and, when transcribed, is recognized by the host cell as a signal to add polyadenosine residues to transcribed mRNA. Any polyadenylation sequence that is functional in the host cell may be used.

In some embodiments, polyadenylation sequences for filamentous fungal host cells are obtained from the genes for *Aspergillus nidulans* anthranilate synthase, *Aspergillus niger* glucoamylase, *Aspergillus niger* alpha-glucosidase, *Aspergillus oryzae* TAKA amylase, and *Fusarium oxysporum* trypsin-like protease.

The control sequence may also be a signal peptide coding region that encodes a signal peptide linked to the N-terminus of a variant and directs the variant glucoamylase being expressed into the cell's secretory pathway. In many instances, the signal sequence is that depicted in FIG. 5, the endogeneous G1P signal sequence.

Effective signal peptide coding sequences for filamentous fungal host cells are the signal peptide coding sequences obtained from the genes for *Aspergillus niger* neutral amylase, *Aspergillus niger* glucoamylase, *Aspergillus oryzae* TAKA amylase, *Humicola insolens* cellulase, *Humicola insolens* endoglucanase V, *Humicola lanuginosa* lipase, and *Rhizomucor miehei* aspartic proteinase.

Useful signal peptides for yeast host cells are obtained from the genes for *Saccharomyces cerevisiae* alpha-factor and *Saccharomyces cerevisiae* invertase. Other useful signal peptide coding sequences are described by Romanos et al., 1992, supra.

Where both signal peptide and propeptide sequences are present, the propeptide sequence is positioned next to the N-terminus of the variant and the signal peptide sequence is positioned next to the N-terminus of the propeptide sequence.

It may also be desirable to add regulatory sequences that regulate expression of the variant relative to the growth of the host cell. Examples of regulatory systems are those that cause expression of the gene to be turned on or off in response to a chemical or physical stimulus, including the presence of a regulatory compound. Regulatory systems in prokaryotic systems include the lac, tac, and trp operator systems. In yeast, the ADH2 system or GAL1 system may be used. In filamentous fungi, the Gpd (Glyceraldehyde-3-phosphate dehydrogenase) from Ascomycota such as *Aspergillus*, *Aspergillus niger* glucoamylase promoter, *Aspergillus oryzae* TAKA alpha-amylase promoter, and *Aspergillus oryzae* glucoamylase promoter can be used. Other examples of regulatory sequences are those that allow for gene amplification. In eukaryotic systems, these regulatory sequences include the dihydrofolate reductase gene that is amplified in the presence of methotrexate, and the metallothionein genes that are amplified with heavy metals. In these cases, the polynucleotide encoding the variant would be operably linked with the regulatory sequence.

2. Expression Vectors

The present invention also relates to recombinant expression vectors comprising a polynucleotide encoding a variant of the present invention, a promoter, and transcriptional and translational stop signals. The various nucleotide and control sequences may be joined together to produce a recombinant expression vector that may include one or more convenient restriction sites to allow for insertion or substitution of the polynucleotide encoding the variant at such sites. Alternatively, the polynucleotide may be expressed by inserting the polynucleotide or a nucleic acid construct comprising the polynucleotide into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the polynucleotide. The choice of the vector will typically depend on the compatibility of the vector with the host cell into which the vector is to be introduced. The vector can be a linear or closed circular plasmid.

The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the host cell, is integrated into the genome and replicated together with the chromosome(s) into which it has been integrated. Furthermore, a single vector or plasmid or two or more vectors or plasmids that together contain the total DNA to be introduced into the genome of the host cell, or a transposon, may be used. Vectors contemplated for use with the methods of the invention include both integrating and non-integrating vectors.

In some embodiments, the vector contains one or more selectable markers that permit easy selection of transformed, transfected, transduced, or the like cells. In many embodiments, the selection genes encode resistance to antibiotics such as ampicillin, ampicillin, chloroamphenicol, hygromycin, tetracycline or kanamycin, etc Suitable markers for yeast host cells include, but are not limited to, ADE2, HIS3, LEU2, LYS2, MET3, TRP1, and URA3. Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Preferred for use in an *Aspergillus* cell are *Aspergillus nidulans* or *Aspergillus oryzae* amdS and pyrG genes and a *Streptomyces hygroscopicus* bar gene.

In some embodiments, the vector contains an element(s) that permits integration of the vector into the host cell's genome or autonomous replication of the vector in the cell independent of the genome.

For integration into the host cell genome, the vector can rely on the polynucleotide's sequence encoding the variant or any other element of the vector for integration into the genome by homologous or non-homologous recombination. Alternatively, the vector can contain additional polynucleotides for directing integration by homologous recombination into the genome of the host cell at a precise location(s) in the chromosome(s). To increase the likelihood of integration at a precise location, the integrational elements should contain a sufficient number of nucleic acids, such as 100 to 10,000 base pairs, 400 to 10,000 base pairs, and 800 to 10,000 base pairs, which have a high degree of sequence identity to the corresponding target sequence to enhance the probability of homologous recombination. The integrational elements may be any sequence that is homologous with the target sequence in the genome of the host cell. Furthermore, the integrational elements may be non-encoding or encoding polynucleotides. On the other hand, the vector may be integrated into the genome of the host cell by non-homologous recombination.

For autonomous replication, the vector can further comprise an origin of replication enabling the vector to replicate autonomously in the host cell in question. The origin of replication can be any plasmid replicator mediating autonomous replication that functions in a cell. The term "origin of replication" or "plasmid replicator" means a polynucleotide that enables a plasmid or vector to replicate in vivo.

Examples of origins of replication for use in a yeast host cell are the 2 micron origin of replication, ARS1, ARS4, the combination of ARS1 and CEN3, and the combination of ARS4 and CEN6.

Examples of origins of replication useful in a filamentous fungal cell are AMA1 and ANSI (Gems et al., 1991, *Gene* 98: 61-67; Cullen et al., 1987, *Nucleic Acids Res.* 15: 9163-9175; WO 00/24883). Isolation of the AMA1 gene and construction of plasmids or vectors comprising the gene can be accomplished according to the methods disclosed in WO 00/24883.

More than one copy of a polynucleotide of the present invention can be inserted into a host cell to increase production of a variant, including the use of multiple genes encoding the variant glucoamylase in a vector, multiple vectors transformed into a cell, or multiple integrations of a vector into the genome. An increase in the copy number of the polynucleotide can be obtained by integrating at least one additional copy of the sequence into the host cell genome or by including an amplifiable selectable marker gene with the polynucleotide where cells containing amplified copies of the selectable marker gene, and thereby additional copies of the polynucleotide, can be selected for by cultivating the cells in the presence of the appropriate selectable agent.

The procedures used to ligate the elements described above to construct the recombinant expression vectors of the present invention are well known to one skilled in the art (see, e.g., Sambrook et al., 1989, supra).

C. Particular Constructs

For expression in yeast, we used *Saccharomyces cerevisiae* INSCV1 strain (ThermoFisher Scientific, USA: Catalogue # V8251-20) and pYES2/CT vector (ThermoFisher Scientific, USA: Catalogue # V8251-20). Both are commercially available and are also discussed in Example 1 below.

1. Codon Optimization

Codon optimization can be employed with any of the variant glucoamylase enzymes of the present invention, in order to optimize expression in the host cell employed. Such methods are well known in the art and described in, for example, WO 2007/142954. In heterologous expression systems, optimization steps can improve the ability of the host to produce the desired variant glucoamylase enzymes. Protein expression is governed by a host of factors including those that affect transcription, mRNA processing, and stability and initiation of translation. The polynucleotide optimization steps can include steps to improve the ability of the host to produce the foreign protein as well as steps to assist the researcher in efficiently designing expression constructs. Optimization strategies can include, for example, the modification of translation initiation regions, alteration of mRNA structural elements, and the use of different codon biases.

In some embodiments, reduced heterologous protein expression occurs through interfering secondary structures. Secondary structures can sequester the RBS sequence or initiation codon and have been correlated to a reduction in protein expression. Stemloop structures can also be involved in transcriptional pausing and attenuation. An optimized polynucleotide sequence can contain minimal secondary structures in the RBS and gene coding regions of the nucleotide sequence to allow for improved transcription and translation.

In some embodiments, restriction sites can effect heterologous protein expression. By modifying restriction sites that could interfere with subsequent sub-cloning of transcription units into host expression vectors a polynucleotide sequence can be optimized.

In some embodiments, the optimized nucleic acid sequence can express the variant glucoamylase enzyme of the invention, at a level which is at least 110%, 150%, 200%, 500%, 1,000%, 5,000% or even 10,000% of that expressed by nucleic acid sequence that has not been optimized.

D. Host Cells and Production Strains

As will be appreciated by those in the art, there are a wide variety of production host organisms for the recombinant production of the variant glucoamylase enzymes of the invention, including, but not limited to bacterial cells and fungal cells including yeast.

The present invention also relates to recombinant host cells, comprising a polynucleotide encoding a variant glucoamlyase of the present invention operably linked to one or more control sequences that direct the production of a variant of the present invention. A construct or vector comprising a polynucleotide is introduced into a host cell so that the construct or vector is maintained as a chromosomal integrant or as a self-replicating extrachromosomal vector as described earlier. The choice of a host cell will to a large extent depend upon the gene encoding the variant and the ability of the host production organism to yield high protein titers of expressed and/or secreted proteins. In some embodiments, the host cell exhibits transitory expression of the variant glucoamlyase. In some embodiments, the host cell is a stably transfected host or a host cell that stably (i.e., permanently) expresses the variant glucoamylase. In some embodiments, the host cell is a production host cell. The transformation and/or transfection of the host cells with the expression vectors comprising the coding region for the variant glucoamylases of the invention is done as is well known in the art (See Sambrook, id.).

The host cell can be any cell useful in the recombinant production of a variant, e.g., a prokaryote or a eukaryote. Such host cells include but are not limited to bacterial, fungal, and yeast cells. The host cell can also be a eukaryote, such as a mammalian, insect, plant, or fungal cell.

The host cell can be a fungal cell. "Fungi" as used herein includes the phyla Ascomycota, Basidiomycota, Chytridiomycota, and Zygomycota as well as the Oomycota and all mitosporic fungi (as defined by Hawksworth et al., In, Ainsworth and Bisby's Dictionary of The Fungi, 8th edition, 1995, CAB International, University Press, Cambridge, UK). In many cases, host cells include *Aspergillus* species including *A. nidulans*, *A. niger* and *A. oryzae*, as well as *Rhizomucor* species such as *R. miehei*, *Trichoderma* species including *T. reesei* and *Fusarium* species genes including *F. venenatum*. The filamentous fungal host cell may be an *Acremonium*, *Aspergillus*, *Aureobasidium*, *Bjerkandera*, *Ceriporiopsis*, *Chrysosporium*, *Coprinus*, *Coriolus*, *Cryptococcus*, *Filibasidium*, *Fusarium*, *Humicola*, *Magnaporthe*, *Mucor*, *Myceliophthora*, *Neocallimastix*, *Neurospora*, *Paecilomyces*, *Penicillium*, *Phanerochaete*, *Phlebia*, *Piromyces*, *Pleurotus*, *Schizophyllum*, *Talaromyces*, *Thermoascus*, *Thielavia*, *Tolypocladium*, *Trametes*, or *Trichoderma* cell. For example, the filamentous fungal host cell may be an *Aspergillus awamori*, *Aspergillus foetidus*, *Aspergillus fumigatus*, *Aspergillus japonicus*, *Aspergillus nidulans*, *Aspergillus niger*, *Aspergillus oryzae*, *Bjerkandera adusta*, *Ceriporiopsis aneirina*, *Ceriporiopsis caregiea*, *Ceriporiopsis gilvescens*, *Ceriporiopsis pannocinta*, *Ceriporiopsis rivulosa*, *Ceriporiopsis subrufa*, *Ceriporiopsis subvermispora*, *Chrysosporium inops*, *Chrysosporium keratinophilum*, *Chrysosporium lucknowense*, *Chrysosporium merdarium*, *Chrysosporium pannicola*, *Chrysosporium queenslandicum*, *Chrysosporium tropicum*, *Chrysosporium zonatum*, *Coprinus cinereus*, *Coriolus hirsutus*, *Fusarium bactridioides*, *Fusarium cerealis*, *Fusarium crookwellense*, *Fusarium culmorum*, *Fusarium graminearum*, *Fusarium graminum*, *Fusarium heterosporum*, *Fusarium negundi*, *Fusarium oxysporum*, *Fusarium reticulaturn*, *Fusarium roseum*, *Fusarium sambucinum*, *Fusarium sarcochroum*, *Fusarium sporotrichioides*, *Fusarium sulphureum*, *Fusarium torulosum*, *Fusarium trichothecioides*, *Fusarium venenatum*, *Humicola insolens*, *Humicola lanuginosa*, *Mucor miehei*, *Myceliophthora thermophila*, *Neurospora crassa*, *Penicillium purpurogenum*, *Phanerochaete chrysosporium*, *Phlebia radiata*, *Pleurotus eryngii*, *Thielavia terrestris*, *Trametes villosa*, *Trametes versicolor*, *Trichoderma harzianum*, *Trichoderma koningii*, *Trichoderma longibrachiatum*, *Trichoderma reesei*, or *Trichoderma viride* cell.

In some embodiments, the fungal host cell can be a yeast cell. "Yeast" as used herein includes ascosporogenous yeast cell. (Endomycetales), basidiosporogenous yeast, and yeast belonging to the Fungi Imperfecti (Blastomycetes). The yeast host cell may be a *Candida*, *Hansenula*, *Kluyveromyces*, *Pichia*, *Saccharomyces*, *Schizosaccharomyces*, or *Yarrowia* cell such as a *Kluyveromyces lactis*, *Saccharomyces carlsbergensis*, *Saccharomyces cerevisiae*, *Saccharomyces diastaticus*, *Saccharomyces douglasii*, *Saccharomyces kluyveri*, *Saccharomyces norbensis*, *Saccharomyces oviformis*, or *Yarrowia lipolytica* cell.

E. Protein Compositions

The present invention also provides compositions comprising a variant glucoamylase enzyme of the present invention. In some embodiments, the composition comprises a carrier and/or an excipient. In some embodiments, the compositions are enriched in such a variant glucoamylase enzyme of the present invention. The term "enriched" indicates that the glucoamylase activity of the composition has been increased, e.g., with an enrichment factor of at least 1. In some embodiments, the compositions are formulated to provide desirable characteristics such as low color, low odor and acceptable storage stability.

In some embodiments, the composition comprises a variant glucoamylase enzyme of the present invention as the major enzymatic component, e.g., a mono-component composition.

In some embodiments, the composition may comprise one or more additional enzymes, depending on the end use, including, but not limited to, aminopeptidase, alpha-amylase, beta-amylase, isoamylase, carbohydrase, carboxypeptidase, catalase, cellulase, chitinase, cutinase, cyclodextrin glycosyltransferase, deoxyribonuclease, esterase, alpha-galactosidase, beta-galactosidase, glucoamylase, alpha-glucosidase, beta-glucosidase, haloperoxidase, invertase, laccase, lipase, mannosidase, oxidase, pectinolytic enzyme, peptidoglutaminase, peroxidase, glucoamylase, polyphenoloxidase, pullulanase, proteolytic enzyme, ribonuclease, transglutaminase, and/or xylanase.

In some embodiments, the composition comprises an alpha-amylase and the variant glucoamylase enzyme according to the invention. In some embodiments, the composition comprises an isoamylase and the variant glucoamylase enzyme according to the invention. In another embodiment the composition comprises an alpha-amylase, an isoamylase and the variant glucoamylase according to the invention.

In some embodiments, the composition comprises the variant glucoamylase enzyme of the invention combined with a pullulanase. In some embodiments, the composition comprises the variant glucoamylase of the invention combined with a pullulanas and an isoamylase. In some embodiments, the composition comprises the variant glucoamylase of the invention combined with a pullulanase and an alpha-amylase.

In some embodiments, the composition comprises the variant glucoamylase enzyme of the invention further comprises acid, neutral and/or alkaline proteases. In another embodiment the composition comprises the variant glucoamylase according to the invention and a cocktail of enzymes including alpha-amylase, proteases, peptidase, lipase, cellulose, pancreatin, and others.

F. Formulations of Variant Glucoamylases

In some embodiments, the compositions can be prepared in accordance with methods known in the art and can be in the form of a liquid or a dry composition. For instance, the composition may be in the form of granulate or microgranulate. The variant can be stabilized in accordance with methods known in the art.

In some embodiments, the enzyme composition (i.e., polypeptide compositions) of the present invention can be in any form suitable for use, such as, for example, a crude fermentation broth with or without cells removed, a cell lysate with or without cellular debris, a semi-purified or purified enzyme composition, or a host cell, as a source of the enzymes.

In some embodiments, the enzyme composition can be a dry powder or granulate, a non-dusting granulate, a liquid, a stabilized liquid, or a stabilized protected enzyme. Liquid enzyme compositions may, for instance, be stabilized by adding stabilizers such as a sugar, a sugar alcohol or another polyol, and/or lactic acid or another organic acid according to established processes.

In some embodiments, the dosage of the polypeptide composition of the invention and other conditions under which the composition is used may be determined on the basis of methods known in the art.

The above compositions are suitable for use in liquefaction, saccharification, and/or fermentation processes, and in some embodiments, in starch conversion. In some embodiments, the compositions are useful for producing a food product, including a syrup, as well as fermentation products, such as ethanol. In some embodiments, the compositions are useful for the pharmaceutical industry, such as in digestive aids.

In addition, as outlined below, the novel glucoamylases of the invention can be combined with other enzymes, including, but not limited to, alpha-amylases, pullulanases, cellulases (xylanases, ligninases, etc.) as more fully described below.

G. Methods of Production

The present invention also relates to methods of producing a variant glucoamylase enzyme, comprising: (a) cultivating a host cell of the present invention under conditions suitable for expression of the variant glucamylase polypeptide; and (b) optionally recovering the variant glucamylase polypeptide.

The host cells are cultivated in a nutrient medium suitable for production of the variant glucamylase polypeptide using methods known in the art. For example, the cell may be cultivated by shake flask cultivation, or small-scale or large-scale fermentation (including continuous, batch, fed-batch, or solid state fermentations) in laboratory or industrial fermentors performed in a suitable medium and under conditions allowing the variant to be expressed and/or isolated. The cultivation takes place in a suitable nutrient medium comprising carbon and nitrogen sources and inorganic salts, using procedures known in the art. Suitable media are available from commercial suppliers or can be prepared according to published compositions (e.g., in catalogues of the American Type Culture Collection). If the variant glucamylase polypeptide is secreted into the nutrient medium, the variant glucamylase polypeptide can be recovered directly from the medium. If the variant is not secreted, it can be recovered from cell lysates.

The variant glucoamylase polypeptide can be detected using methods known in the art that are specific for the variants. These detection methods include, but are not limited to, use of specific antibodies, formation of an enzyme product, or disappearance of an enzyme substrate. For example, an enzyme assay may be used to determine the activity of the variant glucamylase polypeptide.

The variant glucoamylase polypeptide can be recovered using methods known in the art. For example, the variant glucamylase polypeptide can be recovered from the nutrient medium by conventional procedures including, but not limited to, collection, centrifugation, filtration, extraction, spray-drying, evaporation, or precipitation.

The variant can be purified by a variety of procedures known in the art including, but not limited to, chromatography (e.g., ion exchange, affinity, hydrophobic, chromatofocusing, and size exclusion), electrophoretic procedures (e.g., preparative isoelectric focusing), differential solubility (e.g., ammonium sulfate precipitation), SDS-PAGE, or extraction (see, e.g., Protein Purification, Janson and Ryden, editors, VCH Publishers, New York, 1989) to obtain substantially pure variants.

In an alternative aspect, the variant is not recovered, but rather a host cell of the present invention expressing the variant is used as a source of the variant.

H. Methods of Using Variant Glucoamylases

Glucoamylase is regularly used in food and fermentation industries for the saccharification of starch to glucose.

The saccharification process can use glucoamlyase alone. Alternatively the saccharification process can be a synergetic action of a number of enzymes including glucoamylase in combination with amylase (particular α-amylase), and additional debranching enzymes such as pullulanases or isoamylases. Glucose isomerase can be further employed to convert glucose to fructose which is traditionally preferred due to its higher sweetness and easier metabolizability. For example, glucoamylase can be used in doughs to improve bread crust color and produce low-calorie beer. Another key application of glucoamylase is as a digestive aid when used together with a cocktail of other enzymes.

In some embodiments, the glucoamylase are used in animal feed stocks or in the production of animal feed stocks, including the components and use described in detail below.

As discussed herein, the use of glucoamylase enzyme in animal feeds has a number of benefits, including a feed cost savings, such as reductions in dietary inorganic phosphate, energy and amino acids, including a fast and efficient breakdown of dietary glucose and increased nutrient availability from glucose, as well as production benefits such as body weight gain for the non-ruminant subjects. In some embodiments, the variant glucoamylase enzymes of the invention are formulated and added to feed or can be made as a component of the feed. In the former case, the feed stock addition of glucoamylase enzyme can be done by formulating the variant glucoamylase enzyme on a carrier feed such as wheat flour. In some embodiments, the animal feed stocks or supplements are feed to livestock, including but not limited to cattle, pigs, sheep, bird, cat, fish, dog, equine, pet, poultry, etc. In some embodiments, the variant glucoamylase enzymes of the invention can be fed to humans (See, for example http://www.globalhealingcenter.com/natural-health/glucoamylase/)m as well as other commercially available products for human consumption such as Vegan-Zyme®.

In some embodiments, the dosage of the polypeptide composition of the invention and other conditions under which the composition is used may be determined on the basis of methods known in the art.

The above compositions are suitable for use in liquefaction, saccharification, and/or fermentation processes, and in some embodiments, in starch conversion. In some embodiments, the compositions are useful for producing a food product, including a syrup, as well as fermentation products, such as ethanol. In some embodiments, the compositions are useful for the pharmaceutical industry, such as digestive aids.

In one embodiment, the variant glucoamylase enzymes are added to animal feed stock and pelleted as is known in the art, such that the feed is formed with glucoamylase enzyme in it. In other embodiments, the variant glucoamylase enzyme can be sprayed or dosed in a liquid form into animal feed.

I. Methods of Using Variant Glucoamylases

1. Industrial Applications

The variant glucoamylases of the present invention possess valuable properties allowing for a variety of industrial applications. In some embodiments, the glucoamylases may be used in feed stock production, beer making, ethanol production, biofuel production, and starch conversion processes.

In general, the major commercial application of glucoamylase is to catalyze starch saccharification resulting in glucose which can be used in food and fermentation processes. In general, this is a two step process, with the first step utilizing a dry solid starch slurry (30-35%, with optionally milling) that is gelatinized with a thermal treatment at 60 to 90 C with liquefaction at 95-105 C (generally pH 6.5) with an α-amylase. The α-amylase is an endo-acting enzyme, resulting in short-chain dextrins. These dextrins are then saccharified by glucoamylase to release glucose, a step that is usually done at 60 C for 2-4 days. It is this last step that results in the need for a thermostable glucoamylase.

In some embodiments, the present invention provides a biofuel made by the use of a variant glucoamylase enzyme that produces glucose, that is then subjected to a fermentation step to result in ethanol production (usually using a yeast).

The variant glucoamylases may be used for starch processes, in particular starch conversion, especially liquefaction of starch (see, e.g., U.S. Pat. No. 3,912,590, EP 252730 and EP 063909, WO 99/19467, and WO 96/28567, which are all hereby incorporated by reference). Also contemplated are compositions for starch conversion purposes, which may in addition to the glucoamylase of the invention further comprise an alpha-amylase, a pullulanase and/or a protease.

Further, the glucoamylases of the invention are particularly useful in the production of sweeteners and ethanol (see, e.g., U.S. Pat. No. 5,231,017, which is hereby incorporated by reference), such as fuel, drinking and industrial ethanol, from starch or whole grains.

In some embodiments, the present invention relates to a use of the glucoamylase according to the invention for production of syrup and/or a fermentation product from a starch containing material. The starch material may in one embodiment be gelatinized. In another embodiment the starch material is ungelatinized.

2. Starch Processing

As discussed herein, the novel glucoamylase enzymes of the invention find particular use in starch processing. Native starch consists of microscopic granules, which are insoluble in water at room temperature. When aqueous starch slurry is heated, the granules swell and eventually burst, dispersing the starch molecules into the solution. At temperatures up to about 50° C. to 75° C. the swelling may be reversible. However, with higher temperatures an irreversible swelling called "gelatinization" begins. During this "gelatinization" process there is a dramatic increase in viscosity. Granular starch to be processed may be a highly refined starch quality, preferably at least 90%, at least 95%, at least 97% or at least 99.5% pure or it may be a more crude starch-containing materials comprising (e.g., milled) whole grains including non-starch fractions such as germ residues and fibers. The raw material, such as whole grains, may be reduced in particle size, e.g., by milling, in order to open up the structure and allowing for further processing. In dry milling whole kernels are milled and used. Wet milling gives a good separation of germ and meal (starch granules and protein) and is often applied at locations where the starch hydrolyzate is used in the production of, e.g., syrups or other feed supplements. Both dry and wet milling is well known in the art of starch processing and may be used in a process of the invention. Methods for reducing the particle size of the starch containing material are well known to those skilled in the art.

As the solids level is 30-40% in a typical industrial process, the starch has to be thinned or "liquefied" so that it can be suitably processed. This reduction in viscosity is primarily attained by enzymatic degradation in current commercial practice.

Liquefaction can be carried out in the presence of an alpha-amylase, and in some embodiments, the alpha-amylase is a bacterial alpha-amylase and/or acid fungal alpha-amylase. In an embodiment, a glucoamylase is also present during liquefaction. In some embodiments, viscosity reducing enzymes such as a xylanase and/or beta-glucanase is also present during liquefaction. In some embodiments, acid protease is also present. In some embodiments, acid protease is also present to reduce corn steeping time.

In some embodiments, the process of the invention further comprises, prior to the conversion of a starch-containing material to sugars/dextrins the steps of: (i) reducing the particle size of the starch-containing material; and (ii) forming a slurry comprising the starch-containing material and water.

3. Beer Making

The variant glucoamylase enzymes can also be used in a beer-making process and similar fermentations.

J. Distillation

Optionally, following fermentation, an alcohol (e.g., ethanol) can be extracted by, for example, distillation and optionally followed by one or more process steps.

1. Enzymes

The enzyme(s) and polypeptides described below are to be used in an "effective amount" in processes of the present invention or can be combined with the variant glucoamylase enzymes of the invention. In some embodiments, the variant glucoamylase enzymes can be combined with enzymes including but not limited to alpha-amylases, bacterial alpha-amylases, bacterial hybrid alpha-amylases, fungal alpha-amylases, fungal hybrid alpha-amylases, carbohydrate-source generating Enzymes (Saccharifying Enzymes), glucoamylases, beta-amylases, maltogenic amylases, glucoamylases, pullulanases, and proteases.

a. Alpha-Amylases

Any alpha-amylase may be used, such as of fungal, bacterial or plant origin. In some embodiments, the alpha-amylase is an acid alpha-amylase, e.g., acid fungal or acid bacterial alpha-amylase. The term "acid alpha-amylase" means an alpha-amylase (EC 3.2.1.1) which added in an effective amount has activity optimum at a pH in the range of 3 to 7, from 3.5 to 6, or from 4-5.

b. Bacterial Alpha-Amylases

An alpha-amylase for use in the present invention may be a bacterial alpha-amylase, e.g., derived from *Bacillus*. In a preferred embodiment the *Bacillus* alpha-amylase is derived from a strain of *Bacillus amyloliquefaciens, Bacillus licheniformis, Bacillus stearothermophilus*, or *Bacillus subtilis*, but may also be derived from other *Bacillus* sp.

c. Bacterial Hybrid Alpha-Amylases

The alpha-amylase can be a hybrid alpha-amylase, e.g., an alpha-amylase comprising 445 C-terminal amino acid residues of the *Bacillus licheniformis* alpha-amylase and the 37 N-terminal amino acid residues of the alpha-amylase derived from *Bacillus amyloliquefaciens*.

d. Fungal Alpha-Amylases

Fungal alpha-amylases include but are not limited to alpha-amylases derived from a strain of *Aspergillus*, such as, *Aspergillus kawachii, Aspergillus niger*, and *Aspergillus oryzae* alpha-amylases. In some embodiments, the alpha-amylase is derived from *Aspergillus kawachii* (Kaneko et al., 1996, J. Ferment. Bioeng. 81:292-298, "Molecular-cloning and determination of the nucleotide-sequence of a gene encoding an acid-stable alpha-amylase from *Aspergillus kawachii*"; and further as EMBL: #AB008370)

The fungal alpha-amylase may also be a wild-type enzyme comprising a starch-binding domain (SBD) and an alpha-amylase catalytic domain, or a variant thereof.

2. Fungal Hybrid Alpha-Amylases

In some embodiments, the fungal acid alpha-amylase is a hybrid alpha-amylase. A hybrid alpha-amylase may comprise an alpha-amylase catalytic domain (CD) and a carbohydrate-binding domain/module (CBM), such as a starch binding domain (SBD), and optionally a linker.

3. Commercial Alpha-Amylase Products

In some embodiments, commercial compositions comprising alpha-amylase include MYCOLASE™ (DSM), BAN™, TERMAMYL™ SC, FUNGAMYL™, LIQUOZYME™ X, LIQUOZYME™ SC and SAN™ SUPER, SAN™ EXTRA L (Novozymes A/S) and CLARASE™ L-40,000, DEX-LO™, SPEZYME™ FRED, SPEZYME™ AA, SPEZYME™ ALPHA, SPEZYME™ DELTA AA, GC358, GC980, SPEZYME™ CL and SPEZYME™ RSL (DuPont Industrial Biosciences), and the acid fungal alpha-amylase from *Aspergillus niger* referred to as SP288 (available from Novozymes A/S, Denmark).

4. Carbohydrate-Source Generating Enzymes (Saccharifying Enzymes)

The term "carbohydrate-source generating enzyme" includes glucoamylase (a glucose generator), beta-amylase and maltogenic amylase (both maltose generators) and also alpha-glucosidase, isoamylase and pullulanase. A carbohydrate-source generating enzyme is capable of producing a carbohydrate that can be used as an energy-source by the fermenting organism(s) in question, for instance, when used in a process of the invention for producing a fermentation product, such as ethanol. The generated carbohydrate can be converted directly or indirectly to the desired fermentation product, preferably ethanol. A mixture of carbohydrate-source generating enzymes may be used. In some embodiments, blends include mixtures comprising at least a glucoamylase and an alpha-amylase, especially an acid amylase, even more preferred an acid fungal alpha-amylase.

In a conventional starch-to-ethanol process (i.e., including a liquefaction step), the ratio can be carried out as is known in the art, especially when saccharification and fermentation are carried out simultaneously.

5. Beta-Amylases

In some embodiments, a beta-amlyase can be included in the compositions of the invention. A beta-amylase (E.C 3.2.1.2) is the name traditionally given to exo-acting maltogenic amylases, which catalyze the hydrolysis of 1,4-alpha-glucosidic linkages in amylose, amylopectin and related glucose polymers.

Beta-amylases have been isolated from various plants and microorganisms (Fogarty and Kelly, 1979, Progress in Industrial Microbiology 15: 1 12-1 15). These beta-amylases are characterized by having a temperature optimum in the range from 40° C. to 65° C. and a pH optimum in the range from 4.5 to 7. A commercially available beta-amylase from barley is NOVOZYM™ WBA from Novozymes A/S, Denmark and SPEZYME™ BBA 1500 from DuPont Industrial Biosciences, USA.

6. Maltogenic Amylases

In some embodiments, a maltogenic amlyase can be included in the compositions of the invention and/or used in the pocesses of the invention. The amylase can be a maltogenic alpha-amylase (glucan 1,4-alpha-maltohydrolase, EC 3.2.1.133), which catalyzes the hydrolysis of amylose and amylopectin to maltose in the alpha-configuration. A maltogenic amylase from *Bacillus stearothermophilus* strain NCIB 1 1837 is commercially available from Novozymes A/S. Maltogenic.

The maltogenic amylase can be added in an amount of 0.05-5 mg total protein/gram DS or 0.05-5 MANU/g DS.

7. Phytases

In some embodiments, a glucoamylase can be included in the compositions of the invention. Any glucoamylase may be used in a process of the present invention. Phytases are enzymes that degrade phytates and/or phytic acid by specifically hydrolyzing the ester link between inositol and phosphorus. Phytase activity is credited with phosphorus and ion availability in many ingredients. In some embodiments, the glucoamylase is capable of liberating at least one inorganic phosphate from an inositol hexaphosphate (e.g., phytic acid). Phytases can be grouped according to their preference for a specific position of the phosphate ester group on the phytate molecule at which hydrolysis is initiated (e.g., 3-phytase (EC 3.1.3.8) or 6-phytases (EC 3.1.3.26)). An example of phytase is myo-inositol-hexakiphosphate-3-phosphohydrolase. Phytases can also include those in PCT application number PCT/US2016/040555, filed on Jun. 30, 2016, hereby incorporated by reference in its entirety, and in particular for the sequences of the phytases depicted therein.

In some embodiments, the glucoamylase is a commercially-available phytase, such commercially-available phytases include but are not limited to NATUPHOS (BASF), RONOZYME P (Novozymes A/S), PHYZYME (Danisco A/S, Verenium) and FINASE (AB Enzymes). The method for determining microbial phytase activity and the definition of a phytase unit is disclosed in Engelen et al., 1994, *Journal of AOAC International* 77: 760-764. In some embodiments, the phytase can be a wild-type phytase, an active variant or active fragment thereof.

8. Pullulanases

In some embodiments, a maltogenic amlyase can be included in the compositions of the invention and/or used in the pocesses of the invention. Pullulanases (E.C. 3.2.1.41, pullulan 6-glucan-hydrolase), are debranching enzymes characterized by their ability to hydrolyze the alpha-1,6-glycosidic bonds in, for example, amylopectin and pullulan.

In some embodiments, the pullulanase is a commercially-available pullulanase, such commercially-available pullulanases include but are not limited to PROMOZYME D, PROMOZYME™ D2 (Novozymes A/S, Denmark), OPTIMAX L-1000, OPTIMAX L-300 (DuPont Industrial Biosciences), and AMANO 8 (Amano, Japan).

9. Proteases

A protease can be added during saccharification, fermentation, simultaneous saccharification and fermentation. The protease may be any protease. In some embodiments, the protease is an acid protease of microbial origin, for example of fungal or bacterial origin. In some embodiments, the protease is an acid fungal protease, but also other proteases can be used.

Suitable proteases include but are not limited to microbial proteases, such as fungal and bacterial proteases.

In some embodiments, the proteases are acidic proteases, i.e., proteases characterized by the ability to hydrolyze proteins under acidic conditions below pH 7.

The protease can be a neutral or alkaline protease, such as a protease derived from a strain of *Bacillus*. In some embodiments, the particular protease is derived from *Bacillus amyloliquefaciens* and has the sequence obtainable at the Swissprot Database, Accession no. P06832.

In some embodiments, the protease is a protease preparation derived from a strain of *Aspergillus*, such as *Aspergillus oryzae*. In another embodiment the protease is derived from a strain of *Rhizomucor*, such as *Rhizomucor miehei*. In some embodiments the protease is a protease preparation, such as a mixture of a proteolytic preparation derived from a strain of *Aspergillus*, such as *Aspergillus oryzae*, and a protease derived from a strain of *Rhizomucor*, such as *Rhizomucor miehei*.

In some embodiments, the protease is a commercially-available protease, such commercially-available proteases include but are not limited to ALCALASE®, ESPERASE™, FLAVOURZYME™, NEUTRASE®, NOVOZYM™ FM 2.0L, and iZyme BA (available from Novozymes A/S, Denmark) and GC106™ and SPEZYME™ FAN from DuPont Industrial Biosciences, USA, and RENNI LASE® from DSM.

VI. Examples

Example 1: G16 TpGlucoamylase Variant Preparation

Materials and Methods
Gene Synthesis and Cloning

The cDNA sequence of G16 TcGlucoamylase was obtained from UniProt with accession number KKA29558. The gene was synthesized by GenScript (see, the World Wide Web at genscript.com/). The synthesized gene was cloned into the pYES2/CT vector (Thermo Fisher Scientific, USA: Catalogue # V8251-20).

Mutant Design and Construction

To improve the thermostability of G16, two, three, five, one and one mutant collections were designed during G1, G2, G3, G4 and G5 improvement, respectively, based on analyzing sequence, structural and experimental data of G16. The design includes one to multiple specific mutations per mutant. The mutant collections were subsequently constructed using the QuickChange® Lightning kit (Agilent Technologies, Santa Clara, Calif.) and subsequently cloned into the pYES2/CT vector (ThermoFisher Scientific, USA: Catalogue # V8251-20).

Preparation of HTP Glucoamylase-Containing Wet Cell Pellets

The *Saccharomyces cerevisiae* INSCV1 strain (ThermoFisher Scientific, USA: Catalogue # V8251-20) containing recombinant glucoamylase-encoding genes from single colonies were inoculated into individual wells of 96 well plates containing 300 μl synthetic minimal defined medium (SC) with 2% glucose and no uracil supplementation. The cultures were grown overnight at 30° C., 250 rpm and 85% humidity. Appropriate volume of overnight culture from each well needed to obtain an $OD_{600}$ of 0.4 was added to corresponding wells of the new 96 well plates containing 350 μl of induction medium (SC selective medium containing 2% galactose). The plates were then incubated for 24 hrs. at 30° C., 250 rpm and 85% humidity. The cells were then pelleted using centrifugation at 4000 rpm for 10 min at 4° C. The supernatants were discarded and the pellets frozen at −80° C. prior to lysis.

Lysis of the HTP Glucoamylase Plates

150 μL of Y-PER yeast protein extraction reagent (ThermoFisher Scientific, USA: Catalogue #78990) was added to the cell paste in each well as described above. The cells were lysed at room temperature for 1.5 hours with shaking on a bench top shaker. The plate was then centrifuged for 10 min at 4000 rpm and 4° C. The clear supernatants were used to perform biochemical assays to determine activity.

Starch Assay to Determine Glucoamylase Activity a. 150 μL of 1% corn starch vs. potato starch (final concentration of 0.75% starch), 25 μL lysate plus 25 μL pH 5.5 buffer was incubated for 18 hours at 40° C. with 650 rpm agitation. 20 μL of the incubated sample was added to 180 μL GOPOD (glucose oxidase/peroxidase) and incubated for 30 minutes at 50° C. with 150 RPM agitation. Absorbance was read at 510 nm to determine glucose released. As shown in FIG. 1, G16 exhibited significantly higher activity on starch than any other glucoamylases tested.

Assay to Determine Thermogradient of Improved Variants

Figure 2:
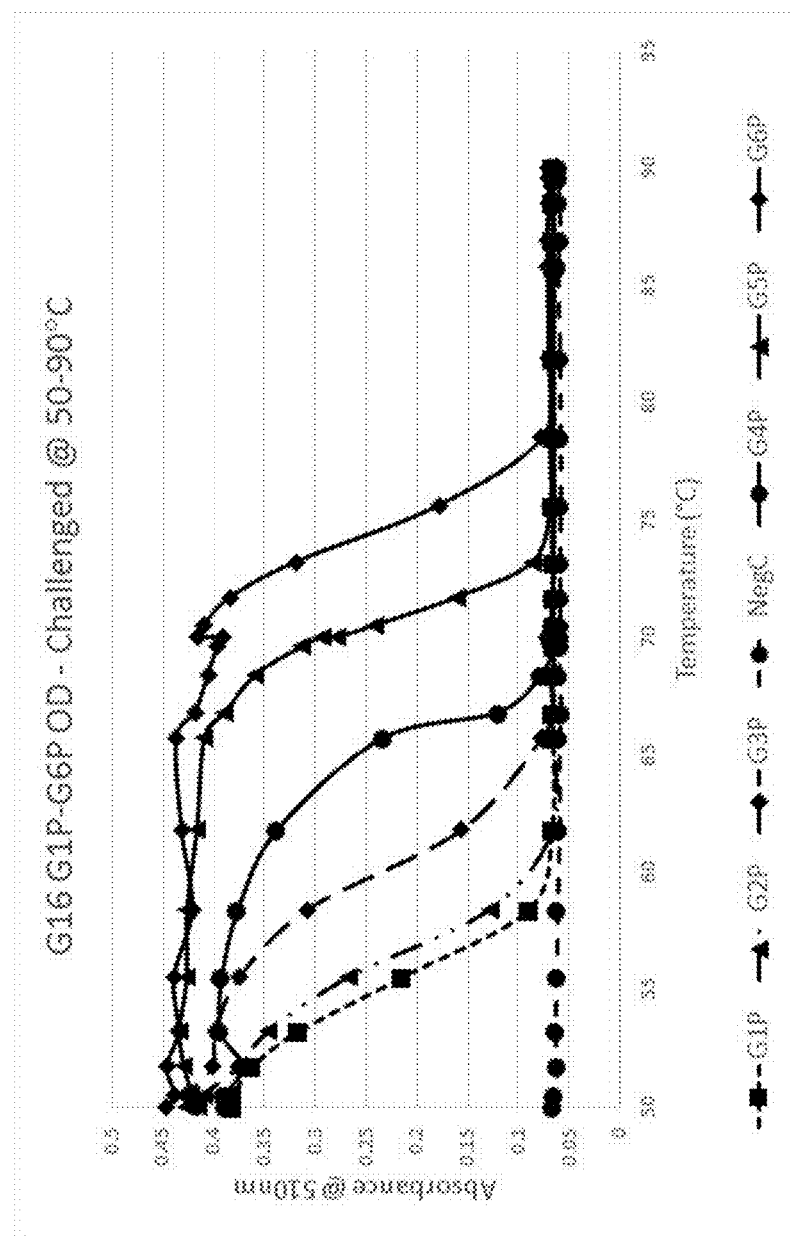
FIG. 2 provides data regarding the thermogradient of G16 G1P, G2P, G3P, G4P, G5P and G6P. For the assay, 50 µl of the enzymes from the lysate plates was added to 96 well Biorad PCR plates and was challenged at 50•90° C. in thermocyclers for 10 minutes. Following the 10 minutes incubation, 20 µl of the challenged lysate was added to 96 deep well starch reaction plates containing 150 µl of 2% corn starch in 0.1M sodium acetate, pH 4.5 (final starch concentration of 1.5%). The final volume was adjusted to 200 µl using 0.1M sodium acetate buffer, pH 4.5. The plates were incubated at 40° C., 800 rpm for 22 hrs. At 22 hrs, the plates were centrifuged at 4000 rpm for 5 minutes and 20 µl of reaction supernatant was taken out into 96 well shallow microtiter plates and 180 µl of D-Glucose assay reagent (GOPOD assay kit from Megazyme, Catalogue # K-GLUC) was added to each well. The plates were then incubated at 50° C. for 30 minutes. Following the incubation, the plates were read at 510 nm to monitor glucose released due to breakdown of starch.

50 µl of the enzymes from the lysate plates was added to 96 well Biorad PCR plates and was challenged at 50●90° C. in thermocyclers for 10 minutes. Following the 10 minutes incubation, 20 µl of the challenged lysate was added to 96 deep well starch reaction plates containing 150 µl of 2% corn starch in 0.1M sodium acetate, pH 4.5 (final starch concentration of 1.5%). The final volume was adjusted to 200 µl using 0.1M sodium acetate buffer, pH 4.5. The plates were incubated at 40° C., 800 rpm for 22 hrs. At 22 hrs, the plates were centrifuged at 4000 rpm for 5 minutes and 20 µl of reaction supernatant was taken out into 96 well shallow microtiter plates and 180 µl of D-Glucose assay reagent (GOPOD assay kit from Megazyme, Catalogue # K-GLUC) was added to each well. The plates were then incubated at 50° C. for 30 minutes. Following the incubation, the plates were read at 510 nm to monitor glucose released due to breakdown of starch. As shown in FIG. 2, G2P-G6P demonstrated much broadened thermoprofile over G1P with G6P being the most thermostable (stable up to 73° C.).

Assay to Determine Thermostability Improvement of Variants

50 µl of the enzymes from the lysate plates was added to 96 well Biorad PCR plates and was challenged at 57° C. (for G1), 59° C. (for G2), 62° C. (for G3), 67° C. (for G4) and 72° C. (for G5) in thermocyclers for 10 minutes. Following the 10 minutes incubation, 20 µl of the challenged lysate was added to 96 deep well starch reaction plates containing 150 µl of 2% corn starch in 0.1M sodium acetate, pH 4.5 (final starch concentration of 1.5%). The final volume was adjusted to 200 µl using 0.1M sodium acetate buffer, pH 4.5. The plates were incubated at 40° C., 800 rpm for 21-48 hrs. At 21-48 hrs, the plates were centrifuged at 4000 rpm for 5 minutes and 20 µl of reaction supernatant was taken out into 96 well shallow microtiter plates and 180 µl of D-Glucose assay reagent (GOPOD assay kit from Megazyme, Catalogue # K-GLUC) was added to each well. The plates were then incubated at 50° C. for 30 minutes. Following the incubation, the plates were read at 510 nm to monitor glucose released due to breakdown of starch. Activity of Glucoamylase variant was compared to the parent under the same conditions to determine thermo stability improvement (FIGS. 3-7).

The examples set forth above are provided to give those of ordinary skill in the art a complete disclosure and description of how to make and use the embodiments of the compositions, systems and methods of the invention, and are not intended to limit the scope of what the inventors regard as their invention. Modifications of the above-described modes for carrying out the invention that are obvious to persons of skill in the art are intended to be within the scope of the following claims. All patents and publications mentioned in the specification are indicative of the levels of skill of those skilled in the art to which the invention pertains. All references cited in this disclosure are incorporated by reference to the same extent as if each reference had been incorporated by reference in its entirety individually.

All headings and section designations are used for clarity and reference purposes only and are not to be considered limiting in any way. For example, those of skill in the art will appreciate the usefulness of combining various aspects from different headings and sections as appropriate according to the spirit and scope of the invention described herein.

All references cited herein are hereby incorporated by reference herein in their entireties and for all purposes to the same extent as if each individual publication or patent or patent application was specifically and individually indicated to be incorporated by reference in its entirety for all purposes.

Many modifications and variations of this application can be made without departing from its spirit and scope, as will be apparent to those skilled in the art. The specific embodiments and examples described herein are offered by way of example only.

SEQUENCE LISTING (363 sequences)

SEQ ID NO: 1 - protein, 598 aa, Artificial Sequence
  Glucoamylase (CL00002146 G16 TpGlucoamylase G1P)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLAEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 2 - DNA, 1794 bp, Artificial Sequence
  Glucoamylase (CL00002146 G16 TpGlucoamylase G1P)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctggctgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 3 - protein, 598 aa, Artificial Sequence
  Synthetic Glucoamylase (CL00004076 G16 TpGlucoamylase G2P)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 4 - DNA, 1794 bp, Artificial Sequence
  Synthetic Glucoamylase (CL00004076 G16 TpGlucoamylase G2P)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 5 - protein, 598 aa, Artificial Sequence
  Synthetic Glucoamylase (CL00016472 G16 TpGlucoamylase G3P)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 6 - DNA, 1794 bp, Artificial Sequence
  Synthetic Glucoamylase (CL00016472 G16 TpGlucoamylase G3P)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 7 - protein, 598 aa, Artificial Sequence
  Synthetic Glucoamylase (CL00004028)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPAGSTVEFKFIRVGSDGSITWESGNNKVLTVGSSATSVTVSASWNGAYSVSSS

SEQ ID NO: 8 - DNA, 1794 bp, Artificial Sequence
  Synthetic Glycoamylase (CL00004028)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttcccgccggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 9 - protein, 598 aa, Artificial Sequence
  Synthetic Glucoamylase (CL00004087)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGFDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 10 - DNA, 1794 bp, Artificial Sequence
  Synthetic Glucoamylase (CL00004087)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggtttcgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 11 - protein, 598 aa, Artificial Sequence
  Synthetic Glucoamylase (CL00004111)
SPVSKRATLDEFISTERPLALEKLLCNIGSTGCRASGASSGVVLASPSTSNPDYYYTWTRDAALVFKEMVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPHGSTVEFKFIRVGSDGSITWESGNNKVLTVGSSATSVTVSASWNGAYSVSSS

SEQ ID NO: 12 - DNA, 1794 bp, Artificial Sequence
  Synthetic Glucoamylase (CL00004111)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagatggtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccacggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 13 - protein, 1794 aa, Artificial Sequence
  Synthetic Glucoamylase (CL00004139)
TCGCCTGTTTCCAAGCGCGCTACGCTGGACGAGTTCATCAGCACCGAGCGTCCCTTGGCTCTGGAGAAGCTGCTCTGCAACATTGGTTCCACTGGTTGCCGTGCTTCGGGAGCTTCTTCGGGAGTCGTTCTGGCCTCGCCGTCCACCAGCAACCCGGACTACTACTACACTTGGACCCGTGATGCTGCTCTGGTCTTTAAGGAGCTGGTCGACTCTGTCGAGACTAACACCACTCTGCTGCTGCCAGAGATTGAGAACTACGTTACTGCCCAGGCTTACCTGCAGACCGTGACGAACCCCTCGGGTTCGCTGTCGGATGGTGCTGGTCTGGGCGAGCCCAAGTTCAACGCTGATTTGACTCAGTTCACTGGTGCCTGGGGTCGTCCTCAGCGTGATGGTCCGGCTCTGCGTGCTACGGCTATGATCGCCTACTACAACTACCTGCTCAACAACAACGCCACTACCGACTGTGGTCTGTGGCAGATTATCCAGAACGACCTGAATTACGTCGCTCAGTACTGGAACCAAACTGGTTACGACCTGTGGGAGGAGGTTCCGGGTTCATCCTTTTTCACTGTTGCTGCTCAGTACAGAGCTCTCGTTGAGGGTTCTACCCTTGCTGCCAAGCTCGGCAAGTCTCACTCGGCCTACGACACTGTCGCTCCGCAGATTCTGTGCTACTTGCAGAGCTTCTGGTCATCCAGCAAGGGCTACATTGTCGCCAACACCCAGACTGCCAGCTGGGTCTCGCGGTCCGGTCTTGATGCCAACACTCCCTTGACTGCCATCCACCTATTTGACCCTGAACTTGGCTGCGATGACTCGACTTTCCAGCCCTGCTCGCCCAAGCAGCTTATCACTACTAAGAAGCTCGTTGACTCGTTCCGCTCCATCTATGCCATCAACTCGGGCAAGTCTGCTGGTACTGCTTTGGCTGTTGGTCGTTACGCCGAGGACGTCTACTACAACGGCAACCCCTGGTACCTGTGCACTTTGGCTGTTGCTGAGCAGCTTTACGATGCAGTTTACACTTGGAAGCTCGAGGGCTCCATCACCGTCACCTCTGTCTCGCTGCCCTTCTTCACTGACCTGCTGCCCTCGCTGACCACTGGCACCTACGCTTCGGGCTCGACCACCTTCGAATCCATCATCTCTGCTGTGACTACCTACGCTGATGGCTTTGTCAGTATTGTCCAGACCTACACTCCCTCTGACGGCGCTCTGTCTGAGCAGTACAACAAGGCCAACGGCCAGCAGCTGTCGGCTCAGGACCTGACCTGGTCGTACGCCGCTTTCCTATCTGCCACTGAGCGCCGTGACAGCGTTGTCCCTGCCGGCTGGGCTGGTGCCTCGTCTGTCTCTGTGCCCGGCGCCTGCGCTGCTACCACCGTTGTCGGAACCTACGCTGCTGCCTCCAACTGCGGTACTCCTGGCTCTGGCTCGGGCGGCAACGGTGGCTCGAGCGGTAACGCCCTGGTGACTTTCAACGAGCTGGCTACTACCTACTACGGCGAGAACATTAAGCTTGTCGGCAGCACAGCTGCTTTCGGTTCGTGGTCGCCCTCAGCTGGTATTCTCCTGTCTGCCTCGTCGTACACGGCCAGCAACCCTCTGTGGACTACCACCGTGTCGGTTCCCCAGGGCTCGACCGTTGAGTTCAAGTTCATCCGTGTTGGCTCCGACGGCAGCATCACGTGGGAGAGCGGCAACAACAAGGTGTTGACGGTTGGCTCTTCGGCCACGAGCGTCACTGTTTCTGCCAGCTGGAACGGCGCCTACTCGGTGTCTAGCTCT

SEQ ID NO: 14 - DNA, 1794 bp, Artificial Sequence
  Synthetic Glucoamylase (CL00004139)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagctggtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 15 - protein, 598 aa, Artificial Sequence
  Synthetic Glucoamylase (CL00004164)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQPLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 16 - DNA, 1794 bp, Artificial Sequence
  Synthetic Glucoamylase (CL00004164)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcccctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 17 - protein, 598 aa, Artificial Sequence
  Synthetic Glucoamylase (CL00004173)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKYIRVGSDGSITWESGNNKVLTVGSSATSVTVSASWNGAYSVSSS

SEQ ID NO: 18 - DNA, 1794 bp, Artificial Sequence
  Synthetic Glucoamylase (CL00004173)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagtacatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 19 - protein, 598 aa, Artificial Sequence
  Synthetic Glucoamylase (CL00004180)
SPVSKRATLDEFISTERPLALEKLLCNIGSTGCRASGASSGVVLASPSTSNPDYYYTWTRDAALVFKELVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPAGSTVEFKFIRVGSDGSITWESGNNKVLTVGSSATSVTVSASWNGAYSVSSS

SEQ ID NO: 20 - DNA, 1794 bp, Artificial Sequence
  Synthetic Glucoamylase (CL00004180)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagctggtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttcccgccggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 21 - protein, 598 aa, Artificial Sequence
  Synthetic Glucoamylase (CL00004190)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTAVAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 22 - DNA, 1794 bp, Artificial Sequence
  Synthetic Glucoamylase (CL00004190)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctgtcgctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 23 - protein, 598 aa, Artificial Sequence
  Synthetic Glucoamylase (CL00004195)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLATHKKLVDSFRSIYAINSGKSAGTAVAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAALGSWSPSAGILLSASSYTASNPLWTTTVSVPAGSTVEFKFIRVGSDGSITWESGNNKVLTVGSSATSVTVSASWNGAYSVSSS

SEQ ID NO: 24 - DNA, 1794 bp, Artificial Sequence
  Synthetic Glucoamylase (CL00004195)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttgccactcacaagaagctcgttgactcgttccgctccatctatgccatcaactcgggcaagtctgctggtactgctgtcgctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctctcggttcgtggtcgccctcagctggtattctcctgtctgcctcgtcgtacacggccagcaaccctctgtggactaccaccgtgtcggttcccgccggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 25 - protein, 598 aa, Artificial Sequence
  Synthetic Glucoamylase (CL00004243)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLAEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPAGSTVEFKFIRVGSDGSITWESGNNKVLTVGSSATSVTVSASWNGAYSVSSS

SEQ ID NO: 26 - DNA, 1794 bp, Artificial Sequence
  Synthetic Glucoamylase (CL00004243)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctggctgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttcccgccggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 27 - protein, 598 aa, Artificial Sequence
  Synthetic Glucoamylase (CL00004280)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAALGSWSPSAGILLSASSYTASNPLWTTTVSVPQGSTVEFKYIRVGSDGSITWESGNNKVLTVGSSATSVTVSASWNGAYSVSSS

SEQ ID NO: 28 - DNA, 1794 bp, Artificial Sequence
  Synthetic Glucoamylase (CL00004280)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctctcggttcgtggtcgccctcagctggtattctcctgtctgcctcgtcgtacacggccagcaaccctctgtggactaccaccgtgtcggttccccagggctcgaccgttgagttcaagtacatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 29 - protein, 598 aa, Artificial Sequence
  Synthetic Glucoamylase (CL00004332)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTSIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPAGSTVEFKFIRVGSDGSITWESGNNKVLTVGSSATSVTVSASWNGAYSVSSS

SEQ ID NO: 30 - DNA, 1794 bp, Artificial Sequence
  Synthetic Glucoamylase (CL00004332)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgacttccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttcccgccggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 31 - protein, 598 aa, Artificial Sequence
  Synthetic Glucoamylase (CL00004396)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGFDLWEEVPGSSFFTVAAQYRALVEGSTLAAKLGKSHSAYDTVAPQILCYLQSFWSSSKGYIVANTQTASWVSRSGLDANTPLTSIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 32 - DNA, 1794 bp, Artificial Sequence
  Synthetic Glucoamylase (CL00004396)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggtttcgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgacttccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 33 - protein, 598 aa, Artificial Sequence
  Synthetic Glucoamylase (CL00004405)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNWLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 34 - DNA, 1794 bp, Artificial Sequence
  Synthetic Glucoamylase (CL00004405)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactggctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 35 - protein, 598 aa, Artificial Sequence
  Synthetic Glucoamylase (CL00004548)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLAEPKFNVDLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSVTWESGNNKVLTVGSSATSVTVSASWNGAYSVSSS

SEQ ID NO: 36 - DNA, 1794 bp, Artificial Sequence
  Synthetic Glucoamylase (CL00004548)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctggctgagcccaagttcaacgtcgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcgtcacgtgggagagcggcaacaacaaggtgttgacggttggctcttcggccacgagcgtcactgtttctgccagctggaacggcgcctactcggtgtctagctct

SEQ ID NO: 37 - protein, 598 aa, Artificial Sequence
  Synthetic Glucoamylase (CL00004562)
SPVSKRATLDEFISTERPLALEKLLCNIGSTGCRASGASSGVVLASPSTSNPDYYYTWTRDAALVFKEIVDSVETNTTLLLPEIENYVTAQAYLQTVSNPSGSLSDGAGLAEPKFNVDLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSVTWESGNNKVLTVGSSATSVTVSASWNGAYSVSSS

SEQ ID NO: 38 - DNA, 1794 bp, Artificial Sequence
  Synthetic Glucoamylase (CL00004562)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgtccaacccctcgggttcgctgtcggatggtgctggtctggctgagcccaagttcaacgtcgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcgtcacgtgggagagcggcaacaacaaggtgttgacggttggctcttcggccacgagcgtcactgtttctgccagctggaacggcgcctactcggtgtctagctct

SEQ ID NO: 39 - protein, 598 aa, Artificial Sequence
  Synthetic Glucoamylase (CL00004574)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLAEPKFNVDLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 40 - DNA, 1794 bp, Artificial Sequence
  Synthetic Glucoamylase (CL00004574)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctggctgagcccaagttcaacgtcgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 41 - protein, 598 aa, Artificial Sequence
  Synthetic Glucoamylase (CL00004612)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLAEPKFNVDLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKHLINTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSVTWESGNNKVLTVGSSATSVTVSASWNGAYSVSSS

SEQ ID NO: 42 - DNA, 1794 bp, Artificial Sequence
  Synthetic Glucoamylase (CL00004612)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctggctgagcccaagttcaacgtcgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcaccttatcaacactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccaaggctcgaccgttgagttcaagttcatccgtgttggctccgacggcagcgtcacgtgggagagcggcaacaacaaggtgttgacggttggctcttcggccacgagcgtcactgtttctgccagctggaacggcgcctactcggtgtctagctct

SEQ ID NO: 43 - protein, 598 aa, Artificial Sequence
  Synthetic Glucoamylase (CL00004664)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLAEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSVTWESGNNKVLTVGSSATSVTVSASWNGAYSVSSS

SEQ ID NO: 44 - DNA, 1794 bp, Artificial Sequence
  Synthetic Glucoamylase (CL00004664)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctggctgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcgtcacgtgggagagcggcaacaacaaggtgttgacggttggctcttcggccacgagcgtcactgtttctgccagctggaacggcgcctactcggtgtctagctct

SEQ ID NO: 45 - protein, 598 aa, Artificial Sequence
  Synthetic Glucoamylase (CL00004761)
SPVSKRATLDEFISTERPLALEKLLCNIGSTGCRASGASSGVVLASPSTSNPDYYYTWTRDAALVFKEIVDSVETNTTLLLPEIENYVTAQAYLQTVSNPSGSLSDGAGLAEPKFNVDLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 46 - DNA, 1794 bp, Artificial Sequence
  Synthetic Glucoamylase (CL00004761)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgtccaacccctcgggttcgctgtcggatggtgctggtctggctgagcccaagttcaacgtcgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 47 - protein, 598 aa, Artificial Sequence
  Synthetic Glucoamylase (CL00004772)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLAEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSLPQGSTVEFKFIRVGSDGSITWESGNNKVLTVGSSATSVTVSASWNGAYSVSSS

SEQ ID NO: 48 - DNA, 1794 bp, Artificial Sequence
  Synthetic Glucoamylase (CL00004772)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctggctgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcgctgccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 49 - protein, 598 aa, Artificial Sequence
  Synthetic Glucoamylase (CL00004828)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLAEPKFNVDLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEYKFIRVGSDGSITWESGNNKVLTVGSSATSVTVSASWNGAYSVSSS

SEQ ID NO: 50 - DNA, 1794 bp, Artificial Sequence
  Synthetic Glucoamylase (CL00004828)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctggctgagcccaagttcaacgtcgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagtacaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 51 - protein, 598 aa, Artificial Sequence
  Synthetic Glucoamylase (CL00004844)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLAEPKFNVDLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLTATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 52 - DNA, 1794 bp, Artificial Sequence
  Synthetic Glucoamylase (CL00004844)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctggctgagcccaagttcaacgtcgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctaaccgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 53 - protein, 598 aa, Artificial Sequence
  Synthetic Glucoamylase (CL00004868)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLAEPKFNVDLTQFTGAWGRPQRDGPALRATAMIAYYNYLLNNNATTDCGLWQIIQNDLNYVAQYWNQTGYDLWEEVPGSSFFTVAAQHRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSLPQGSTVEFKFIRVGSDGSITWESGNNKVLTVGSSATSVTVSASWNGAYSVSSS

SEQ ID NO: 54 - DNA, 1794 bp, Artificial Sequence
  Synthetic Glucoamylase (CL00004868)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctggctgagcccaagttcaacgtcgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagcacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcgctgccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 55 - protein, 598 aa, Artificial Sequence
  Synthetic Glucoamylase (CL00004885)
SPVSKRATLDEFISTERPLALEKLLCNIGSTGCRASGASSGVVLASPSTSNPDYYYTWTRDAALVFKEIVDSVETNTTLLLPEIENYVTAQAYLQTVSNPSGSLSDGAGLAEPKFNVDLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEYKFIRVGSDGSITWESGNNKVLTVGSSATSVTVSASWNGAYSVSSS

SEQ ID NO: 56 - DNA, 1794 bp, Artificial Sequence
  Synthetic Glucoamylase (CL00004885)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgtccaacccctcgggttcgctgtcggatggtgctggtctggctgagcccaagttcaacgtcgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagtacaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 57 - protein, 598 aa, Artificial Sequence
  Synthetic Glucoamylase (CL00016320)
SPVSKRATLDEFISTERPLALEKLLCNIGNTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 58 - DNA, 1794 bp, Artificial Sequence
  Synthetic Glucoamylase (CL00016320)
tcgcctgtttccaagcgcgctacgctggacgagttcatcagcaccgagcgtcccttggctctggagaagctgctctgcaacattggtaatactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 59 - protein, 598 aa, Artificial Sequence
  Synthetic Glucoamylase (CL00016361)
SPVSKRATLDEFISTERPLALEKLLCNIGSTGCRASGASSGVVLASPSRSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 60 - DNA, 1794 bp, Artificial Sequence
  Synthetic Glucoamylase (CL00016361)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaggagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 61 - protein, 598 aa, Artificial Sequence
  Synthetic Glucoamylase (CL00016436)
SPVSKRATLDEFISTERPLALEKLLCNIGSTGCRASGASSGVVIASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 62 - DNA, 1794 bp, Artificial Sequence
  Synthetic Glucoamylase (CL00016436)
tcgcctgtttccaagcgcgctacgctggacgagttcatcagcaccgagcgtcccttggctctggagaagctgctctgcaacattggttccactggttgccgtgcttcgggagcttcttcgggagtcgttattgcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 63 - protein, 598 aa, Artificial Sequence
  Synthetic Glucoamylase (CL00016454)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNPDLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 64 - DNA, 1794 bp, Artificial Sequence
  Synthetic Glucoamylase (CL00016454)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaaccctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 65 - protein, 598 aa, Artificial Sequence
  Synthetic Glucoamylase (CL00016475)
SPVSKRATLDEFISTERPLALENLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 66 - DNA, 1794 bp, Artificial Sequence
  Synthetic Glucoamylase (CL00016475)
tcgcctgtttccaagcgcgctacgctggacgagttcatcagcaccgagcgtcccttggctctggagaatctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 67 - protein, 598 aa, Artificial Sequence
  Synthetic Glucoamylase (CL00016506)
SPVSKRATLDEFISTERPLALEKLLCNIGSNGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 68 - DNA, 1794 bp, Artificial Sequence
  Synthetic Glucoamylase (CL00016506)
tcgcctgtttccaagcgcgctacgctggacgagttcatcagcaccgagcgtcccttggctctggagaagctgctctgcaacattggttccaatggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 69 - protein, 598 aa, Artificial Sequence
  Synthetic Glucoamylase (CL00016557)
SPVSKRATLDEFISTERPLALEKLLCNIGSEGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 70 - DNA, 1794 bp, Artificial Sequence
  Synthetic Glucoamylase (CL00016557)
tcgcctgtttccaagcgcgctacgctggacgagttcatcagcaccgagcgtcccttggctctggagaagctgctctgcaacattggttccgagggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 71 - protein, 598 aa, Artificial Sequence
  Synthetic Glucoamylase (CL00016562)
SPVSKRATLDEFISTERPLALEKLLCNIGSTGCRASGASSGVVLASPSTSNPNYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 72 - DNA, 1794 bp, Artificial Sequence
  Synthetic Glucoamylase (CL00016562)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccgaattactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 73 - protein, 598 aa, Artificial Sequence
  Synthetic Glucoamylase (CL00016595)
SPVSKRATLDEFISTERPLALEKLLCNIGSTGCRASGASSGVVLASPSTSDPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 74 - DNA, 1794 bp, Artificial Sequence
  Synthetic Glucoamylase (CL00016595)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 75 - protein, 598 aa, Artificial Sequence
  Synthetic Glucoamylase (CL00016641)
SPVSKRATLDEFISTERPLALEKLLCNIGSTGCRASGAASGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 76 - DNA, 1794 bp, Artificial Sequence
  Synthetic Glucoamylase (CL00016641)
tcgcctgtttccaagcgcgctacgctggacgagttcatcagcaccgagcgtcccttggctctggagaagctgctctgcaacattggttccactggttgccgtgcttcgggagctgcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 77 - protein, 598 aa, Artificial Sequence
  Synthetic Glucoamylase (CL00016684)
SPVSKRATLDEFISTERPLALERLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 78 - DNA, 1794 bp, Artificial Sequence
  Synthetic Glucoamylase (CL00016684)
tcgcctgtttccaagcgcgctacgctggacgagttcatcagcaccgagcgtcccttggctctggagcggctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 79 - protein, 598 aa, Artificial Sequence
  Synthetic Glucoamylase (CL00016693)
SPVSKRATLDEFISTERPLALEKLLCNIGSTGCRLSGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 80 - DNA, 1794 bp, Artificial Sequence
  Synthetic Glucoamylase (CL00016693)
tcgcctgtttccaagcgcgctacgctggacgagttcatcagcaccgagcgtcccttggctctggagaagctgctctgcaacattggttccactggttgccgtctttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 81 - protein, 598 aa, Artificial Sequence
  Synthetic Glucoamylase (CL00016720)
SPVSKRATLDEFISTERPLALEKLLCNIGSQGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 82 - DNA, 1794 bp, Artificial Sequence
  Synthetic Glucoamylase (CL00016720)
tcgcctgtttccaagcgcgctacgctggacgagttcatcagcaccgagcgtcccttggctctggagaagctgctctgcaacattggttcccagggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 83 - protein, 598 aa, Artificial Sequence
  Synthetic Glucoamylase (CL00016727)
SPVSKRATLDEFISTERPLALEKLLCNIGSKGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 84 - DNA, 1794 bp, Artificial Sequence
  Synthetic Glucoamylase (CL00016727)
tcgcctgtttccaagcgcgctacgctggacgagttcatcagcaccgagcgtcccttggctctggagaagctgctctgcaacattggttccaagggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 85 - protein, 598 aa, Artificial Sequence
  Synthetic Glucoamylase (CL00016755)
SPVSKRATLDEFISTERPLALEKLLCNIGSTGCRASGASSGVVLASPSTINPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 86 - DNA, 1794 bp, Artificial Sequence
  Synthetic Glucoamylase (CL00016755)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccatcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 87 - protein, 598 aa, Artificial Sequence
  Synthetic Glucoamylase (CL00016817)
SPVSKRATLDEFISTERPLALEKLLCNIGSTGCRASGASSGVVLASPSTYNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 88 - DNA, 1794 bp, Artificial Sequence
  Synthetic Glucoamylase (CL00016817)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccacctataacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 89 - protein, 598 aa, Artificial Sequence
  Synthetic Glucoamylase (CL00016854)
SPVSKRATLDEFISTERPLALEKLLCNIGSTGCRASGASSGVVLASPSKSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 90 - DNA, 1794 bp, Artificial Sequence
  Synthetic Glucoamylase (CL00016854)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaagagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 91 - protein, 598 aa, Artificial Sequence
  Synthetic Glucoamylase (CL00016961)
SPVSKRATLDEFISTERPLALEYLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 92 - DNA, 1794 bp, Artificial Sequence
  Synthetic Glucoamylase (CL00016961)
tcgcctgtttccaagcgcgctacgctggacgagttcatcagcaccgagcgtcccttggctctggagtatctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 93 - protein, 598 aa, Artificial Sequence
  Synthetic Glucoamylase (CL00017089)
SPVSKRATLDEFISTERPLALEKLLCNIGSTGCRASGASSGVVLASPSTENPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 94 - DNA, 1794 bp, Artificial Sequence
  Synthetic Glucoamylase (CL00017089)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccgagaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 95 - protein, 598 aa, Artificial Sequence
  Synthetic Glucoamylase (CL00017126)
SPVSKRATLDEFISTERPLALEKLLCNIGSTGCRARGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 96 - DNA, 1794 bp, Artificial Sequence
  Synthetic Glucoamylase (CL00017126)
tcgcctgtttccaagcgcgctacgctggacgagttcatcagcaccgagcgtcccttggctctggagaagctgctctgcaacattggttccactggttgccgtgctcggggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 97 - protein, 598 aa, Artificial Sequence
  Synthetic Glucoamylase (CL00017170)
SPVSKRATLDEFISTERPLALEKLLCNIGDTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 98 - DNA, 1794 bp, Artificial Sequence
  Synthetic Glucoamylase (CL00017170)
tcgcctgtttccaagcgcgctacgctggacgagttcatcagcaccgagcgtcccttggctctggagaagctgctctgcaacattggtgatactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 99 - protein, 598 aa, Artificial Sequence
  Synthetic Glucoamylase (CL00017342)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSAESYTASNPLWTTTVSVPQGSTVEFKFIRVGSDGSITWESGNNKVLTVGSSATSVTVSASWNGAYSVSSS

SEQ ID NO: 100 - DNA, 1794 bp, Artificial Sequence
  Synthetic Glucoamylase (CL00017342)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgccgagtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 101 - protein, 598 aa, Artificial Sequence
  Synthetic Glucoamylase (CL00017353)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWSTTVSVPQGSTVEFKFIRVGSDGSITWESGNNKVLTVGSSATSVTVSASWNGAYSVSSS

SEQ ID NO: 102 - DNA, 1794 bp, Artificial Sequence
  Synthetic Glucoamylase (CL00017353)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggtcgaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 103 - protein, 598 aa, Artificial Sequence
  Synthetic Glucoamylase (CL00017376)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTAENPLWTTTVSVPQGSTVEFKFIRVGSDGSITWESGNNKVLTVGSSATSVTVSASWNGAYSVSSS

SEQ ID NO: 104 - DNA, 1794 bp, Artificial Sequence
  Synthetic Glucoamylase (CL00017376)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccgagaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 105 - protein, 598 aa, Artificial Sequence
  Synthetic Glucoamylase (CL00017379)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSAGSYTASNPLWTTTVSVPQGSTVEFKFIRVGSDGSITWESGNNKVLTVGSSATSVTVSASWNGAYSVSSS

SEQ ID NO: 106 - DNA, 1794 bp, Artificial Sequence
  Synthetic Glucoamylase (CL00017379)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgccggttcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 107 - protein, 598 aa, Artificial Sequence
  Synthetic Glucoamylase (CL00017499)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYKASNPLWTTTVSVPQGSTVEFKFIRVGSDGSITWESGNNKVLTVGSSATSVTVSASWNGAYSVSSS

SEQ ID NO: 108 - DNA, 1794 bp, Artificial Sequence
  Synthetic Glucoamylase (CL00017499)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacaaggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 109 - protein, 598 aa, Artificial Sequence
  Synthetic Glucoamylase (CL00017545)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTLSNPLWTTTVSVPQGSTVEFKFIRVGSDGSITWESGNNKVLTVGSSATSVTVSASWNGAYSVSSS

SEQ ID NO: 110 - DNA, 1794 bp, Artificial Sequence
  Synthetic Glucoamylase (CL00017545)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacgcttagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 111 - protein, 598 aa, Artificial Sequence
  Synthetic Glucoamylase (CL00017619)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTATNPLWTTTVSVPQGSTVEFKFIRVGSDGSITWESGNNKVLTVGSSATSVTVSASWNGAYSVSSS

SEQ ID NO: 112 - DNA, 1794 bp, Artificial Sequence
  Synthetic Glucoamylase (CL00017619)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccacgaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 113 - protein, 598 aa, Artificial Sequence
  Synthetic Glucoamylase (CL00017633)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 114 - DNA, 1794 bp, Artificial Sequence
  Synthetic Glucoamylase (CL00017633)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcctgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 115 - protein, 598 aa, Artificial Sequence
  Synthetic Glucoamylase (CL00017677)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAMDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 116 - DNA, 1794 bp, Artificial Sequence
  Synthetic Glucoamylase (CL00017677)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctatggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 117 - protein, 598 aa, Artificial Sequence
  Synthetic Glucoamylase (CL00017800)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTAFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 118 - DNA, 1794 bp, Artificial Sequence
  Synthetic Glucoamylase (CL00017800)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactgcgttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 119 - protein, 598 aa, Artificial Sequence
  Synthetic Glucoamylase (CL00017915)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTAGNPLWTTTVSVPQGSTVEFKFIRVGSDGSITWESGNNKVLTVGSSATSVTVSASWNGAYSVSSS

SEQ ID NO: 120 - DNA, 1794 bp, Artificial Sequence
  Synthetic Glucoamylase (CL00017915)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccgggaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 121 - protein, 598 aa, Artificial Sequence
  Synthetic Glucoamylase (CL00017966)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWATTVSVPQGSTVEFKFIRVGSDGSITWESGNNKVLTVGSSATSVTVSASWNGAYSVSSS

SEQ ID NO: 122 - DNA, 1794 bp, Artificial Sequence
  Synthetic Glucoamylase (CL00017966)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtgggctaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 123 - protein, 598 aa, Artificial Sequence
  Synthetic Glucoamylase (CL00017998)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 124 - DNA, 1794 bp, Artificial Sequence
  Synthetic Glucoamylase (CL00017998)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 125 - protein, 598 aa, Artificial Sequence
  Synthetic Glucoamylase (CL00018049)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTPFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 126 - DNA, 1794 bp, Artificial Sequence
  Synthetic Glucoamylase (CL00018049)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcctttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 127 - protein, 598 aa, Artificial Sequence
  Synthetic Glucoamylase (CL00018121)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTAKNPLWTTTVSVPQGSTVEFKFIRVGSDGSITWESGNNKVLTVGSSATSVTVSASWNGAYSVSSS

SEQ ID NO: 128 - DNA, 1794 bp, Artificial Sequence
  Synthetic Glucoamylase (CL00018121)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccaagaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 129 - protein, 598 aa, Artificial Sequence
  Synthetic Glucoamylase (CL00018170)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTPSASWNGAYSVSSS

SEQ ID NO: 130 - DNA, 1794 bp, Artificial Sequence
  Synthetic Glucoamylase (CL00018170)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactccgtctgccagctggaacggcgcctactcggtgtctagctct

SEQ ID NO: 131 - protein, 598 aa, Artificial Sequence
  Synthetic Glucoamylase (CL00018240)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSFTVSASWNGAYSVSSS

SEQ ID NO: 132 - DNA, 1794 bp, Artificial Sequence
  Synthetic Glucoamylase (CL00018240)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagctttactgtttctgccagctggaacggcgcctactcggtgtctagctct

SEQ ID NO: 133 - protein, 598 aa, Artificial Sequence
  Synthetic Glucoamylase (CL00018397)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVRSSATSVTVSASWNGAYSVSSS

SEQ ID NO: 134 - DNA, 1794 bp, Artificial Sequence
  Synthetic Glucoamylase (CL00018397)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttcggtcttcggccacgagcgtcactgtttctgccagctggaacggcgcctactcggtgtctagctct

SEQ ID NO: 135 - protein, 598 aa, Artificial Sequence
  Synthetic Glucoamylase (CL00018457)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSAKSVTVSASWNGAYSVSSS

SEQ ID NO: 136 - DNA, 1794 bp, Artificial Sequence
  Synthetic Glucoamylase (CL00018457)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccaagagcgtcactgtttctgccagctggaacggcgcctactcggtgtctagctct

SEQ ID NO: 137 - protein, 598 aa, Artificial Sequence
  Synthetic Glucoamylase (CL00018469)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTIGSSATSVTVSASWNGAYSVSSS

SEQ ID NO: 138 - DNA, 1794 bp, Artificial Sequence
  Synthetic Glucoamylase (CL00018469)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacgattggctcttcggccacgagcgtcactgtttctgccagctggaacggcgcctactcggtgtctagctct

SEQ ID NO: 139 - protein, 598 aa, Artificial Sequence
  Synthetic Glucoamylase (CL00018672)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNEVLTVGSSATSVTVSASWNGAYSVSSS

SEQ ID NO: 140 - DNA, 1794 bp, Artificial Sequence
  Synthetic Glucoamylase (CL00018672)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacgaggtgttgacggttggctcttcggccacgagcgtcactgtttctgccagctggaacggcgcctactcggtgtctagctct

SEQ ID NO: 141 - protein, 598 aa, Artificial Sequence
  Synthetic Glucoamylase (CL00018828)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTLGSSATSVTVSASWNGAYSVSSS

SEQ ID NO: 142 - DNA, 1794 bp, Artificial Sequence
  Synthetic Glucoamylase (CL00018828)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacgttgggctcttcggccacgagcgtcactgtttctgccagctggaacggcgcctactcggtgtctagctct

SEQ ID NO: 143 - protein, 598 aa, Artificial Sequence
  Synthetic Glucoamylase (CL00018997)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSAQWNGAYSVSSS

SEQ ID NO: 144 - DNA, 1794 bp, Artificial Sequence
  Synthetic Glucoamylase (CL00018997)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgcccagtggaacggcgcctactcggtgtctagctct

SEQ ID NO: 145 - protein, 598 aa, Artificial Sequence
  Synthetic Glucoamylase (CL00019056)
SPVSKRATLDEFISTERPLALEKLLCNIGSTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSAISVTVSASWNGAYSVSSS

SEQ ID NO: 146 - DNA, 1794 bp, Artificial Sequence
  Synthetic Glucoamylase (CL00019056)
tcgcctgtttccaagcgcgctacgctggacgagttcatcagcaccgagcgtcccttggctctggagaagctgctctgcaacattggttccactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccattagcgtcactgtttctgccagctggaacggcgcctactcggtgtctagctct

SEQ ID NO: 147 - protein, 598 aa, Artificial Sequence
  Synthetic Glucoamylase (CL00019320)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 148 - DNA, 1794 bp, Artificial Sequence
  Synthetic Glucoamylase (CL00019320)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactcgaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 149 - protein, 598 aa, Artificial Sequence
  Synthetic Glucoamylase (CL00019387)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYDKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 150 - DNA, 1794 bp, Artificial Sequence
  Synthetic Glucoamylase (CL00019387)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacgataaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 151 - protein, 598 aa, Artificial Sequence
  Synthetic Glucoamylase (CL00019415)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFADLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 152 - DNA, 1794 bp, Artificial Sequence
  Synthetic Glucoamylase (CL00019415)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcgctgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 153 - protein, 598 aa, Artificial Sequence
  Synthetic Glucoamylase (CL00019452)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPPACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 154 - DNA, 1794 bp, Artificial Sequence
  Synthetic Glucoamylase (CL00019452)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgccccctgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 155 - protein, 598 aa, Artificial Sequence
  Synthetic Glucoamylase (CL00019453)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATFVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 156 - DNA, 1794 bp, Artificial Sequence
  Synthetic Glucoamylase (CL00019453)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctacctttgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 157 - protein, 598 aa, Artificial Sequence
  Synthetic Glucoamylase (CL00019474)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYKEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 158 - DNA, 1794 bp, Artificial Sequence
  Synthetic Glucoamylase (CL00019474)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacaaggaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 159 - protein, 598 aa, Artificial Sequence
  Synthetic Glucoamylase (CL00019610)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVKTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 160 - DNA, 1794 bp, Artificial Sequence
  Synthetic Glucoamylase (CL00019610)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgaagacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 161 - protein, 598 aa, Artificial Sequence
  Synthetic Glucoamylase (CL00020066)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVITYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 162 - DNA, 1794 bp, Artificial Sequence
  Synthetic Glucoamylase (CL00020066)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgattacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 163 - protein, 598 aa, Artificial Sequence
  Synthetic Glucoamylase (CL00020100)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVYTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 164 - DNA, 1794 bp, Artificial Sequence
  Synthetic Glucoamylase (CL00020100)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgtatacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 165 - protein, 598 aa, Artificial Sequence
  Synthetic Glucoamylase (CL00020102)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPNACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 166 - DNA, 1794 bp, Artificial Sequence
  Synthetic Glucoamylase (CL00020102)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccaatgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 167 - protein, 598 aa, Artificial Sequence
  Synthetic Glucoamylase (CL00020149)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVYGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 168 - DNA, 1794 bp, Artificial Sequence
  Synthetic Glucoamylase (CL00020149)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggtttatggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 169 - protein, 598 aa, Artificial Sequence
  Synthetic Glucoamylase (CL00020167)
SPVSKRATLDEFISTERPLALERLLCNIGPTGCRASGAASGVVLASPSTSDPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 170 - DNA, 1794 bp, Artificial Sequence
  Synthetic Glucoamylase (CL00020167)
tcgcctgtttccaagcgcgctacgctggacgagttcatcagcaccgagcgtcccttggctctggagcgcctgctctgcaacattggtcctactggttgccgtgcttcgggagctgcctcgggagtcgttctggcctcgccgtccaccagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 171 - protein, 598 aa, Artificial Sequence
  Synthetic Glucoamylase (CL00020218)
SPVSKRATLDEFISTERPLALERLLCNIGPTGCRASGAASGVVLASPSTENPDYYYTWTRDAALVFKEIVDSVETNTTLLLPEIENYVTAQAYLQTVTNPSGSLSDGAGLGEPKFNADMTPFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 172 - DNA, 1794 bp, Artificial Sequence
  Synthetic Glucoamylase (CL00020218)
tcgcctgtttccaagcgcgctacgctggacgagttcatcagcaccgagcgtcccttggctctggagcgcctgctctgcaacattggtcctactggttgccgtgcttcgggagctgcctcgggagtcgttctggcctcgccgtccaccgagaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 173 - protein, 598 aa, Artificial Sequence
  Synthetic Glucoamylase (CL00020270)
SPVSKRATLDEFISTERPLALERLLCNIGPTGCRASGASSGVVLASPSKENPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 174 - DNA, 1794 bp, Artificial Sequence
  Synthetic Glucoamylase (CL00020270)
tcgcctgtttccaagcgcgctacgctggacgagttcatcagcaccgagcgtcccttggctctggagcgcctgctctgcaacattggtcctactggttgccgtgcttcgggagcttcttcgggagtcgttctggcctcgccgtccaaggagaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 175 - protein, 598 aa, Artificial Sequence
  Synthetic Glucoamylase (CL00020288)
SPVSKRATLDEFISTERPLALERLLCNIGPTGCRASGASSGVVLASPSTEDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 176 - DNA, 1794 bp, Artificial Sequence
  Synthetic Glucoamylase (CL00020288)
tcgcctgtttccaagcgcgctacgctggacgagttcatcagcaccgagcgtcccttggctctggagcgcctgctctgcaacattggtcctactggttgccgtgcttcgggagcttcttcgggagtcgttctggcctcgccgtccaccgaggatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 177 - protein, 598 aa, Artificial Sequence
  Synthetic Glucoamylase (CL00020306)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADMTAFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 178 - DNA, 1794 bp, Artificial Sequence
  Synthetic Glucoamylase (CL00020306)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactgccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 179 - protein, 598 aa, Artificial Sequence
  Synthetic Glucoamylase (CL00020315)
SPVSKRATLDEFISTERPLALEKLLCNIGPTGCRASGAASGVVLASPSTIDPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 180 - DNA, 1794 bp, Artificial Sequence
  Synthetic Glucoamylase (CL00020315)
tcgcctgtttccaagcgcgctacgctggacgagttcatcagcaccgagcgtcccttggctctggagaagctgctctgcaacattggtcctactggttgccgtgcttcgggagctgcctcgggagtcgttctggcctcgccgtccaccatcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 181 - protein, 598 aa, Artificial Sequence
  Synthetic Glucoamylase (CL00020318)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 182 - DNA, 1794 bp, Artificial Sequence
  Synthetic Glucoamylase (CL00020318)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 183 - protein, 597 aa, Artificial Sequence
  Synthetic Glucoamylase (CL00020323)
SPVSKRATLDEFISTERPLALERLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSS

SEQ ID NO: 184 - DNA, 1794 bp, Artificial Sequence
  Synthetic Glucoamylase (CL00020323)
tcgcctgtttccaagcgcgctacgctggacgagttcatcagcaccgagcgtcccttggctctggagcgcctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 185 - protein, 598 aa, Artificial Sequence
  Synthetic Glucoamylase (CL00020336)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNPDLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 186 - DNA, 1794 bp, Artificial Sequence
  Synthetic Glucoamylase (CL00020336)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaaccccgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 187 - protein, 598 aa, Artificial Sequence
  Synthetic Glucoamylase (CL00020355)
SPVSKRATLDEFISTERPLALEKLLCNIGPTGCRASGAASGVVLASPSTSNPDYYYTWTRDAALVFKEIVDSVETNTTLLLPEIENYVTAQAYLQTVTNPSGSLSDGAGLGEPKFNVDLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 188 - DNA, 1794 bp, Artificial Sequence
  Synthetic Glucoamylase (CL00020355)
tcgcctgtttccaagcgcgctacgctggacgagttcatcagcaccgagcgtcccttggctctggagaagctgctctgcaacattggtcctactggttgccgtgcttcgggagctgcctcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 189 - protein, 598 aa, Artificial Sequence
  Synthetic Glucoamylase (CL00020386)
SPVSKRATLDEFISTERPLALEKLLCNIGPTGCRASGAASGVVLASPSRSNPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 190 - DNA, 1794 bp, Artificial Sequence
  Synthetic Glucoamylase (CL00020386)
tcgcctgtttccaagcgcgctacgctggacgagttcatcagcaccgagcgtcccttggctctggagaagctgctctgcaacattggtcctactggttgccgtgcttcgggagctgcctcgggagtcgttctggcctcgccgtcccgcagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 191 - protein, 598 aa, Artificial Sequence
  Synthetic Glucoamylase (CL00020416)
SPVSKRATLDEFISTERPLALEKLLCNIGPTGCRASGASSGVVLASPSKSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 192 - DNA, 1794 bp, Artificial Sequence
  Synthetic Glucoamylase (CL00020416)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaagagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 193 - protein, 598 aa, Artificial Sequence
  Synthetic Glucoamylase (CL00020450)
SPVSKRATLDEFISTERPLALEKLLCNIGPTGCRASGASSGVVLASPSTSDPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 194 - DNA, 1794 bp, Artificial Sequence
  Synthetic Glucoamylase (CL00020450)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 195 - protein, 598 aa, Artificial Sequence
  Synthetic Glucoamylase (CL00020452)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNVDMTPFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 196 - DNA, 1794 bp, Artificial Sequence
  Synthetic Glucoamylase (CL00020452)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 197 - protein, 598 aa, Artificial Sequence
  Synthetic Glucoamylase (CL00020483)
SPVSKRATLDEFISTERPLALEKLLCNIGPTGCRASGASSGVVLASPSRSNPDYYYTWTRDAALVFKEIVDSVETNTTLLLPEIENYVTAQAYLQTVTNPSGSLSDGAGLGEPKFNPDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 198 - DNA, 1794 bp, Artificial Sequence
  Synthetic Glucoamylase (CL00020483)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtcccgcagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaaccccgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 199 - protein, 598 aa, Artificial Sequence
  Synthetic Glucoamylase (CL00020486)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 200 - DNA, 1794 bp, Artificial Sequence
  Synthetic Glucoamylase (CL00020486)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 201 - protein, 598 aa, Artificial Sequence
  Synthetic Glucoamylase (CL00020487)
SPVSKRATLDEFISTERPLALEKLLCNIGPTGCRASGAASGVVLASPSRIDPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 202 - DNA, 1794 bp, Artificial Sequence
  Synthetic Glucoamylase (CL00020487)
tcgcctgtttccaagcgcgctacgctggacgagttcatcagcaccgagcgtcccttggctctggagaagctgctctgcaacattggtcctactggttgccgtgcttcgggagctgcctcgggagtcgttctggcctcgccgtcccgcatcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 203 - protein, 598 aa, Artificial Sequence
  Synthetic Glucoamylase (CL00020492)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNVDLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 204 - DNA, 1794 bp, Artificial Sequence
  Synthetic Glucoamylase (CL00020492)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 205 - protein, 598 aa, Artificial Sequence
  Synthetic Glucoamylase (CL00020544)
SPVSKRATLDEFISTERPLALEKLLCNIGPTGCRASGAASGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 206 - DNA, 1794 bp, Artificial Sequence
  Synthetic Glucoamylase (CL00020544)
tcgcctgtttccaagcgcgctacgctggacgagttcatcagcaccgagcgtcccttggctctggagaagctgctctgcaacattggtcctactggttgccgtgcttcgggagctgcctcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccacagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 207 - protein, 598 aa, Artificial Sequence
  Synthetic Glucoamylase (CL00020555 G16 TpGlucoamylase G4P)
SPVSKRATLDEFISTERPLALERLLCNIGPTGCRASGAASGVVLASPSKSNPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 208 - DNA, 1794 bp, Artificial Sequence
  Synthetic Glucoamylase (CL00020555 G16 TpGlucoamylase G4P)
tcgcctgtttccaagcgcgctacgctggacgagttcatcagcaccgagcgtcccttggctctggagcgcctgctctgcaacattggtcctactggttgccgtgcttcgggagctgcctcgggagtcgttctggcctcgccgtccaagagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 209 - protein, 598 aa, Artificial Sequence
  Synthetic Glucoamylase (CL00020558)
SPVSKRATLDEFISTERPLALERLLCNIGPTGCRASGASSGVVLASPSRSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 210 - DNA, 1794 bp, Artificial Sequence
  Synthetic Glucoamylase (CL00020558)
tcgcctgtttccaagcgcgctacgctggacgagttcatcagcaccgagcgtcccttggctctggagcgcctgctctgcaacattggtcctactggttgccgtgcttcgggagcttcttcgggagtcgttctggcctcgccgtcccgcagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 211 - protein, 598 aa, Artificial Sequence
  Synthetic Glucoamylase (CL00020574)
SPVSKRATLDEFISTERPLALERLLCNIGPTGCRASGASSGVVLASPSTSDPDYYYTWTRDAALVFKEIVDSVETNTTLLLPEIENYVTAQAYLQTVTNPSGSLSDGAGLGEPKFNADMTPFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 212 - DNA, 1794 bp, Artificial Sequence
  Synthetic Glucoamylase (CL00020574)
tcgcctgtttccaagcgcgctacgctggacgagttcatcagcaccgagcgtcccttggctctggagcgcctgctctgcaacattggtcctactggttgccgtgcttcgggagcttcttcgggagtcgttctggcctcgccgtccaccagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 213 - protein, 598 aa, Artificial Sequence
  Synthetic Glucoamylase (CL00020744)
SPVSKRATLDEFISTERPLALEKLLCNIGPTGCRASGASSGVVIASPSTSNPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 214 - DNA, 1794 bp, Artificial Sequence
  Synthetic Glucoamylase (CL00020744)
tcgcctgtttccaagcgcgctacgctggacgagttcatcagcaccgagcgtcccttggctctggagaagctgctctgcaacattggtcctactggttgccgtgcttcgggagcttcttcgggagtcgttatcgcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 215 - protein, 598 aa, Artificial Sequence
  Synthetic Glucoamylase (CL00020876)
SPVSKRATLDEFISTERPLALEKLLCNIGPKGCRASGASSGVVLASPSTSNPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 216 - DNA, 1794 bp, Artificial Sequence
  Synthetic Glucoamylase (CL00020876)
tcgcctgtttccaagcgcgctacgctggacgagttcatcagcaccgagcgtcccttggctctggagaagctgctctgcaacattggtcctaagggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 217 - protein, 598 aa, Artificial Sequence
  Synthetic Glucoamylase (CL00020973)
SPVSKRATLDEFISTERPLALEKLLCNIGPTGCRASGASSGVVIASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 218 - DNA, 1794 bp, Artificial Sequence
  Synthetic Glucoamylase (CL00020973)
tcgcctgtttccaagcgcgctacgctggacgagttcatcagcaccgagcgtcccttggctctggagaagctgctctgcaacattggtcctactggttgccgtgcttcgggagcttcttcgggagtcgttatcgcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 219 - protein, 598 aa, Artificial Sequence
  Synthetic Glucoamylase (CL00021116)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKNNGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 220 - DNA, 1794 bp, Artificial Sequence
  Synthetic Glucoamylase (CL00021116)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaagaataacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 221 - protein, 598 aa, Artificial Sequence
  Synthetic Glucoamylase (CL00021226)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQKYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 222 - DNA, 1794 bp, Artificial Sequence
  Synthetic Glucoamylase (CL00021226)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagaagtacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 223 - protein, 598 aa, Artificial Sequence
  Synthetic Glucoamylase (CL00021526)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKDNGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 224 - DNA, 1794 bp, Artificial Sequence
  Synthetic Glucoamylase (CL00021526)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggataacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 225 - protein, 598 aa, Artificial Sequence
  Synthetic Glucoamylase (CL00021667)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKYNGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 226 - DNA, 1794 bp, Artificial Sequence
  Synthetic Glucoamylase (CL00021667)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaagtataacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 227 - protein, 598 aa, Artificial Sequence
  Synthetic Glucoamylase (CL00021717)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKKEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 228 - DNA, 1794 bp, Artificial Sequence
  Synthetic Glucoamylase (CL00021717)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagaaggagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 229 - protein, 598 aa, Artificial Sequence
  Synthetic Glucoamylase (CL00021908)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKTNGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 230 - DNA, 1794 bp, Artificial Sequence
  Synthetic Glucoamylase (CL00021908)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaagacgaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 231 - protein, 598 aa, Artificial Sequence
  Synthetic Glucoamylase (CL00021943)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKWNGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 232 - DNA, 1794 bp, Artificial Sequence
  Synthetic Glucoamylase (CL00021943)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaagtggaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 233 - protein, 598 aa, Artificial Sequence
  Synthetic Glucoamylase (CL00022008)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKFNGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 234 - DNA, 1794 bp, Artificial Sequence
  Synthetic Glucoamylase (CL00022008)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaagtttaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 235 - protein, 598 aa, Artificial Sequence
  Synthetic Glucoamylase (CL00022111)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGQALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 236 - DNA, 1794 bp, Artificial Sequence
  Synthetic Glucoamylase (CL00022111)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtcaggctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 237 - protein, 598 aa, Artificial Sequence
  Synthetic Glucoamylase (CL00022195)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIILAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 238 - DNA, 1794 bp, Artificial Sequence
  Synthetic Glucoamylase (CL00022195)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatcttggctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 239 - protein, 598 aa, Artificial Sequence
  Synthetic Glucoamylase (CL00022224)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIIQAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 240 - DNA, 1794 bp, Artificial Sequence
  Synthetic Glucoamylase (CL00022224)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatccaggctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 241 - protein, 598 aa, Artificial Sequence
  Synthetic Glucoamylase (CL00022403)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVERSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 242 - DNA, 1794 bp, Artificial Sequence
  Synthetic Glucoamylase (CL00022403)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtcgagcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 243 - protein, 598 aa, Artificial Sequence
  Synthetic Glucoamylase (CL00022407)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGEALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 244 - DNA, 1794 bp, Artificial Sequence
  Synthetic Glucoamylase (CL00022407)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtgaggctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 245 - protein, 598 aa, Artificial Sequence
  Synthetic Glucoamylase (CL00022549)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGDALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 246 - DNA, 1794 bp, Artificial Sequence
  Synthetic Glucoamylase (CL00022549)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtgatgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 247 - protein, 598 aa, Artificial Sequence
  Synthetic Glucoamylase (CL00022582)
SPVSKRATLDEFIQTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 248 - DNA, 1794 bp, Artificial Sequence
  Synthetic Glucoamylase (CL00022582)
tcgcctgtttccaagcgcgctacgctggacgagttcatccagaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 249 - protein, 598 aa, Artificial Sequence
  Synthetic Glucoamylase (CL00022777)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVDRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 250 - DNA, 1794 bp, Artificial Sequence
  Synthetic Glucoamylase (CL00022777)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtcgatcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 251 - protein, 598 aa, Artificial Sequence
  Synthetic Glucoamylase (CL00022849)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVKRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 252 - DNA, 1794 bp, Artificial Sequence
  Synthetic Glucoamylase (CL00022849)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtcaagcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 253 - protein, 598 aa, Artificial Sequence
  Synthetic Glucoamylase (CL00023051)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYQINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 254 - DNA, 1794 bp, Artificial Sequence
  Synthetic Glucoamylase (CL00023051)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatcagatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 255 - protein, 598 aa, Artificial Sequence
  Synthetic Glucoamylase (CL00023110)
SPVSKRATLDEFISTERPLALEKLLCNIGPTGCRASGASSGVVLASPSTSNPDYYYTWTRDAALVFKEIVDSVETNTTLLLPEIENYVTAQAYLQTVTNPSGSLSDGAGLGEPKFNADLTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYLINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAQDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 256 - DNA, 1794 bp, Artificial Sequence
  Synthetic Glucoamylase (CL00023110)
tcgcctgtttccaagcgcgctacgctggacgagttcatcagcaccgagcgtcccttggctctggagaagctgctctgcaacattggtcctactggttgccgtgcttcgggagcttcttcgggagtcgttctggcctcgccgtccaccagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatttgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatctgatcaactcgggcaagtctgctggtactgctttggctgttggtcgttacgccgaggacgtctactacaacggcaacccctggtacctgtgcactttggctgttgctgagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcaggacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 257 - protein, 598 aa, Artificial Sequence
  Synthetic Glucoamylase (CL00023236)
SPVSKRATLDEFISTERPLALERLLCNIGPEGCRASGAASGVVLASPSKSDPDYYYTWTRDAALVFKEIVDSVETNTTLLLPEIENYVTAQAYLQTVTNPSGSLSDGAGLGEPKFNADMTPFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 258 - DNA, 1794 bp, Artificial Sequence
  Synthetic Glucoamylase (CL00023236)
tcgcctgtttccaagcgcgctacgctggacgagttcatcagcaccgagcgtcccttggctctggagcgcctgctctgcaacattggtcctgagggttgccgtgcttcgggagctgcctcgggagtcgttctggcctcgccgtccaagagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 259 - protein, 598 aa, Artificial Sequence
  Synthetic Glucoamylase (CL00023239)
SPVSKRATLDEFISTERPLALERLLCNIGPEGCRASGAASGVVLASPSRSNPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYDKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 260 - DNA, 1794 bp, Artificial Sequence
  Synthetic Glucoamylase (CL00023239)
tcgcctgtttccaagcgcgctacgctggacgagttcatcagcaccgagcgtcccttggctctggagcgcctgctctgcaacattggtcctgagggttgccgtgcttcgggagctgcctcgggagtcgttctggcctcgccgtcccgcagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacgataaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 261 - protein, 598 aa, Artificial Sequence
  Synthetic Glucoamylase (CL00023294)
SPVSKRATLDEFISTERPLALERLLCNIGPEGCRASGAASGVVLASPSRSDPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 262 - DNA, 1794 bp, Artificial Sequence
  Synthetic Glucoamylase (CL00023294)
tcgcctgtttccaagcgcgctacgctggacgagttcatcagcaccgagcgtcccttggctctggagcgcctgctctgcaacattggtcctgagggttgccgtgcttcgggagctgcctcgggagtcgttctggcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 263 - protein, 598 aa, Artificial Sequence
  Synthetic Glucoamylase (CL00023295)
SPVSKRATLDEFISTERPLALERLLCNIGPTGCRASGAASGVVIASPSKSNPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 264 - DNA, 1794 bp, Artificial Sequence
  Synthetic Glucoamylase (CL00023295)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtccaagagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 265 - protein, 598 aa, Artificial Sequence
  Synthetic Glucoamylase (CL00023354)
SPVSKRATLDEFISTERPLALERLLCNIGPTGCRASGAASGVVLASPSKSNPDYYYTWTRDAALVFKEIVDSVETNTTLLLPEIENYVTAQAYLQTVTNPSGSLSDGAGLGEPKFNADMTPFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 266 - DNA, 1794 bp, Artificial Sequence
  Synthetic Glucoamylase (CL00023354)
tcgcctgtttccaagcgcgctacgctggacgagttcatcagcaccgagcgtcccttggctctggagcgcctgctctgcaacattggtcctactggttgccgtgcttcgggagctgcctcgggagtcgttctggcctcgccgtccaagagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 267 - protein, 598 aa, Artificial Sequence
  Synthetic Glucoamylase (CL00023407)
SPVSKRATLDEFISTERPLALERLLCNIGPTGCRASGAASGVVLASPSKSNPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYDKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 268 - DNA, 1794 bp, Artificial Sequence
  Synthetic Glucoamylase (CL00023407)
tcgcctgtttccaagcgcgctacgctggacgagttcatcagcaccgagcgtcccttggctctggagcgcctgctctgcaacattggtcctactggttgccgtgcttcgggagctgcctcgggagtcgttctggcctcgccgtccaagagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacgataaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 269 - protein, 598 aa, Artificial Sequence
  Synthetic Glucoamylase (CL00023426)
SPVSKRATLDEFISTERPLALERLLCNIGPTGCRASGAASGVVLASPSRSDPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 270 - DNA, 1794 bp, Artificial Sequence
  Synthetic Glucoamylase (CL00023426)
tcgcctgtttccaagcgcgctacgctggacgagttcatcagcaccgagcgtcccttggctctggagcgcctgctctgcaacattggtcctactggttgccgtgcttcgggagctgcctcgggagtcgttctggcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 271 - protein, 598 aa, Artificial Sequence
  Synthetic Glucoamylase (CL00023478)
SPVSKRATLDEFISTERPLALERLLCNIGPEGCRASGAASGVVLASPSRSNPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 272 - DNA, 1794 bp, Artificial Sequence
  Synthetic Glucoamylase (CL00023478)
tcgcctgtttccaagcgcgctacgctggacgagttcatcagcaccgagcgtcccttggctctggagcgcctgctctgcaacattggtcctgagggttgccgtgcttcgggagctgcctcgggagtcgttctggcctcgccgtcccgcagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 273 - protein, 598 aa, Artificial Sequence
  Synthetic Glucoamylase (CL00023479)
SPVSKRATLDEFISTERPLALERLLCNIGPEGCRASGAASGVVIASPSKSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 274 - DNA, 1794 bp, Artificial Sequence
  Synthetic Glucoamylase (CL00023479)
tcgcctgtttccaagcgcgctacgctggacgagttcatcagcaccgagcgtcccttggctctggagcgcctgctctgcaacattggtcctgagggttgccgtgcttcgggagctgcctcgggagtcgttatcgcctcgccgtccaagagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 275 - protein, 598 aa, Artificial Sequence
  Synthetic Glucoamylase (CL00023484)
SPVSKRATLDEFISTERPLALERLLCNIGPEGCRASGAASGVVLASPSRSDPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYDKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 276 - DNA, 1794 bp, Artificial Sequence
  Synthetic Glucoamylase (CL00023484)
tcgcctgtttccaagcgcgctacgctggacgagttcatcagcaccgagcgtcccttggctctggagcgcctgctctgcaacattggtcctgagggttgccgtgcttcgggagctgcctcgggagtcgttctggcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacgataaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 277 - protein, 598 aa, Artificial Sequence
  Synthetic Glucoamylase (CL00023486)
SPVSKRATLDEFISTERPLALERLLCNIGPTGCRASGAASGVVIASPSRSDPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYDKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 278 - DNA, 1794 bp, Artificial Sequence
  Synthetic Glucoamylase (CL00023486)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacgataaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 279 - protein, 598 aa, Artificial Sequence
  Synthetic Glucoamylase (CL00023488)
SPVSKRATLDEFISTERPLALERLLCNIGPEGCRASGAASGVVLASPSRNDPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDWGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 280 - DNA, 1794 bp, Artificial Sequence
  Synthetic Glucoamylase (CL00023488)
tcgcctgtttccaagcgcgctacgctggacgagttcatcagcaccgagcgtcccttggctctggagcgcctgctctgcaacattggtcctgagggttgccgtgcttcgggagctgcctcgggagtcgttctggcctcgccgtcccgcaacgatccggactactactacacttggacccgtgatgctgctctggtctttaaggagattgtcgactctgtcgagactaacaccactctgctgctgccagaaattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactggggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 281 - protein, 598 aa, Artificial Sequence
  Synthetic Glucoamylase (CL00023516)
SPVSKRATLDEFISTERPLALERLLCNIGPTGCRASGAASGVVLASPSRSDPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 282 - DNA, 1794 bp, Artificial Sequence
  Synthetic Glucoamylase (CL00023516)
tcgcctgtttccaagcgcgctacgctggacgagttcatcagcaccgagcgtcccttggctctggagcgcctgctctgcaacattggtcctactggttgccgtgcttcgggagctgcctcgggagtcgttctggcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 283 - protein, 598 aa, Artificial Sequence
  Synthetic Glucoamylase (CL00023614)
SPVSKRATLDEFISTERPLALERLLCNIGPTGCRASGAASGVVIASPSRSDPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 284 - DNA, 1794 bp, Artificial Sequence
  Synthetic Glucoamylase (CL00023614)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 285 - protein, 598 aa, Artificial Sequence
  Synthetic Glucoamylase (CL00023622)
SPVSKRATLDEFISTERPLALERLLCNIGPTGCRASGAASGVVIASPSRSNPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 286 - DNA, 1794 bp, Artificial Sequence
  Synthetic Glucoamylase (CL00023622)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 287 - protein, 598 aa, Artificial Sequence
  Synthetic Glucoamylase (CL00023672)
SPVSKRATLDEFISTERPLALERLLCNIGPTGCRASGAASGVVIASPSKSDPDYYYTWTRDAALVFKEIVDSVETNTTLLLPEIENYVTAQAYLQTVTNPSGSLSDGAGLGEPKFNVDMTAFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 288 - DNA, 1794 bp, Artificial Sequence
  Synthetic Glucoamylase (CL00023672)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtccaagagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactgccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 289 - protein, 598 aa, Artificial Sequence
  Synthetic Glucoamylase (CL00023679)
SPVSKRATLDEFISTERPLALERLLCNIGPEGCRASGAASGVVIASPSRSNPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 290 - DNA, 1794 bp, Artificial Sequence
  Synthetic Glucoamylase (CL00023679)
tcgcctgtttccaagcgcgctacgctggacgagttcatcagcaccgagcgtcccttggctctggagcgcctgctctgcaacattggtcctgagggttgccgtgcttcgggagctgcctcgggagtcgttatcgcctcgccgtcccgcagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 291 - protein, 598 aa, Artificial Sequence
  Synthetic Glucoamylase (CL00023711)
SPVSKRATLDEFISTERPLALERLLCNIGPTGCRASGAASGVVIASPSKSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 292 - DNA, 1794 bp, Artificial Sequence
  Synthetic Glucoamylase (CL00023711)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtccaagagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 293 - protein, 598 aa, Artificial Sequence
  Synthetic Glucoamylase (CL00023719)
SPVSKRATLDEFISTERPLALERLLCNIGPEGCRASGAASGVVIASPSRSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 294 - DNA, 1794 bp, Artificial Sequence
  Synthetic Glucoamylase (CL00023719)
tcgcctgtttccaagcgcgctacgctggacgagttcatcagcaccgagcgtcccttggctctggagcgcctgctctgcaacattggtcctgagggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 295 - protein, 598 aa, Artificial Sequence
  Synthetic Glucoamylase (CL00023752)
SPVSKRATLDEFISTERPLALERLLCNIGPTGCRASGAASGVVLASPSKSNPDYYYTWTRDAALVFKEIVDSVETNTTLLLPEIENYVTAQAYLQTVTNPSGSLSDGAGLGEPKFNVDMTAFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYDKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 296 - DNA, 1794 bp, Artificial Sequence
  Synthetic Glucoamylase (CL00023752)
tcgcctgtttccaagcgcgctacgctggacgagttcatcagcaccgagcgtcccttggctctggagcgcctgctctgcaacattggtcctactggttgccgtgcttcgggagctgcctcgggagtcgttctggcctcgccgtccaagagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactgccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacgataaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactactaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 297 - protein, 598 aa, Artificial Sequence
  Synthetic Glucoamylase (CL00023756)
SPVSKRATLDEFISTERPLALERLLCNIGPEGCRASGAASGVVIASPSRSNPDYYYTWTRDAALVFKEIVDSVETNTTLLLPEIENYVTAQAYLQTVTNPSGSLSDGAGLGEPKFNVDMTPFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 298 - DNA, 1794 bp, Artificial Sequence
  Synthetic Glucoamylase (CL00023756)
tcgcctgtttccaagcgcgctacgctggacgagttcatcagcaccgagcgtcccttggctctggagcgcctgctctgcaacattggtcctgagggttgccgtgcttcgggagctgcctcgggagtcgttatcgcctcgccgtcccgcagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 299 - protein, 598 aa, Artificial Sequence
  Synthetic Glucoamylase (CL00023779)
SPVSKRATLDEFISTERPLALERLLCNIGPTGCRASGAASGVVLASPSKSDPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 300 - DNA, 1794 bp, Artificial Sequence
  Synthetic Glucoamylase (CL00023779)
tcgcctgtttccaagcgcgctacgctggacgagttcatcagcaccgagcgtcccttggctctggagcgcctgctctgcaacattggtcctactggttgccgtgcttcgggagctgcctcgggagtcgttctggcctcgccgtccaagagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 301 - protein, 598 aa, Artificial Sequence
  Synthetic Glucoamylase (CL00023782)
SPVSKRATLDEFISTERPLALERLLCNIGPEGCRASGAASGVVIASPSRSNPDYYYTWTRDAALVFKEIVDSVETNTTLLLPEIENYVTAQAYLQTVTNPSGSLSDGAGLGEPKFNADMTPFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 302 - DNA, 1794 bp, Artificial Sequence
  Synthetic Glucoamylase (CL00023782)
tcgcctgtttccaagcgcgctacgctggacgagttcatcagcaccgagcgtcccttggctctggagcgcctgctctgcaacattggtcctgagggttgccgtgcttcgggagctgcctcgggagtcgttatcgcctctccgtcccgcagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 303 - protein, 598 aa, Artificial Sequence
  Synthetic Glucoamylase (CL00023800)
SPVSKRATLDEFISTERPLALERLLCNIGPTGCRASGAASGVVIASPSRSNPDYYYTWTRDAALVFKEIVDSVETNTTLLLPEIENYVTAQAYLQTVTNPSGSLSDGAGLGEPKFNADMTPFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 304 - DNA, 1794 bp, Artificial Sequence
  Synthetic Glucoamylase (CL00023800)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 305 - protein, 598 aa, Artificial Sequence
  Synthetic Glucoamylase (CL00023809)
SPVSKRATLDEFISTERPLALERLLCNIGPTGCRASGAASGVVIASPSRSNPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 306 - DNA, 1794 bp, Artificial Sequence
  Synthetic Glucoamylase (CL00023809)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactactaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 307 - protein, 598 aa, Artificial Sequence
  Synthetic Glucoamylase (CL00023829 G16 TpGlucoamylase G5P)
SPVSKRATLDEFISTERPLALERLLCNIGPTGCRASGAASGVVIASPSRSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 308 - DNA, 1794 bp, Artificial Sequence
  Synthetic Glucoamylase (CL00023829 G16 TpGlucoamylase G5P)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 309 - protein, 598 aa, Artificial Sequence
  Synthetic Glucoamylase (CL00023840)
SPVSKRATLDEFISTERPLALERLLCNIGPTGCRASGAASGVVLASPSKSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 310 - DNA, 1794 bp, Artificial Sequence
  Synthetic Glucoamylase (CL00023840)
tcgcctgtttccaagcgcgctacgctggacgagttcatcagcaccgagcgtcccttggctctggagcgcctgctctgcaacattggtcctactggttgccgtgcttcgggagctgcctcgggagtcgttctggcctcgccgtccaagagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 311 - protein, 598 aa, Artificial Sequence
  Synthetic Glucoamylase (Synthetic Glucoamylase ()
SPVSKRATLDEFISTERPLALERLLCNIGPTGCRASGAASGVVLASPSKSDPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 312 - DNA, 1794 bp, Artificial Sequence
  Synthetic Glucoamylase (CL00023848)
tcgcctgtttccaagcgcgctacgctggacgagttcatcagcaccgagcgtcccttggctctggagcgcctgctctgcaacattggtcctactggttgccgtgcttcgggagctgcctcgggagtcgttctggcctcgccgtccaagagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 313 - protein, 598 aa, Artificial Sequence
  Synthetic Glucoamylase (CL00023883)
SPVSKRATLDEFISTERPLALERLLCNIGPEGCRASGAASGVVIASPSRSNPDYYYTWTRDAALVFKEIVDSVETNTTLLLPEIENYVTAQAYLQTVTNPSGSLSDGAGLGEPKFNADMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYNKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 314 - DNA, 1794 bp, Artificial Sequence
  Synthetic Glucoamylase (CL00023883)
tcgcctgtttccaagcgcgctacgctggacgagttcatcagcaccgagcgtcccttggctctggagcgcctgctctgcaacattggtcctgagggttgccgtgcttcgggagctgcctcgggagtcgttatcgcctcgccgtcccgcagcaacccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgctgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatttatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacaacaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 315 - protein, 598 aa, Artificial Sequence
  Synthetic Glucoamylase (CL00023944)
SPVSKRATLDEFISTERPLALERLLCNIGPEGCRASGAASGVVIASPSRSDPDYYYTWTRDAALVFKEIVDSVETNTTLLLPEIENYVTAQAYLQTVTNPSGSLSDGAGLGEPKFNVDMTAFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYDKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 316 - DNA, 1794 bp, Artificial Sequence
  Synthetic Glucoamylase (CL00023944)
tcgcctgtttccaagcgcgctacgctggacgagttcatcagcaccgagcgtcccttggctctggagcgcctgctctgcaacattggtcctgagggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactgccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacgataaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 317 - protein, 598 aa, Artificial Sequence
  Synthetic Glucoamylase (CL00023972)
SPVSKRATLDEFISTERPLALERLLCNIGPTGCRASGAASGVVIASPSRSDPDYYYTWTRDAALVFKEIVDSVETNTTLLLPEIENYVTAQAYLQTVTNPSGSLSDGAGLGEPKFNVDMTPFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYDKNNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 318 - DNA, 1794 bp, Artificial Sequence
  Synthetic Glucoamylase (CL00023972)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacgataagaacaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 319 - protein, 598 aa, Artificial Sequence
  Synthetic Glucoamylase (CL00024013)
SPVSKRATLDEFISTERPLALERLLCNIGPTGCRASGAASGVVIASPSRSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKWNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 320 - DNA, 1794 bp, Artificial Sequence
  Synthetic Glucoamylase (CL00024013)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaagtggaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 321 - protein, 598 aa, Artificial Sequence
  Synthetic Glucoamylase (CL00024024)
SPVSKRATLDEFISTERPLALERLLCNIGPTGCRASGAASGVVIASPSRSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKFNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 322 - DNA, 1794 bp, Artificial Sequence
  Synthetic Glucoamylase (CL00024024)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaagttcaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 323 - protein, 598 aa, Artificial Sequence
  Synthetic Glucoamylase (CL00024038)
SPVSKRATLDEFISTERPLALERLLCNIGPTGCRASGAASGVVIASPSRSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGDALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKSNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 324 - DNA, 1794 bp, Artificial Sequence
  Synthetic Glucoamylase (CL00024038)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtgatgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaagtccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 325 - protein, 598 aa, Artificial Sequence
  Synthetic Glucoamylase (CL00024053)
SPVSKRATLDEFISTERPLALERLLCNIGPTGCRASGAASGVVIASPSRSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGEALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 326 - DNA, 1794 bp, Artificial Sequence
  Synthetic Glucoamylase (CL00024053)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtgaggctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 327 - protein, 598 aa, Artificial Sequence
  Synthetic Glucoamylase (CL00024074)
SPVSKRATLDEFISTERPLALERLLCNIGPTGCRASGAASGVVIASPSRSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGEALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKWNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 328 - DNA, 1794 bp, Artificial Sequence
  Synthetic Glucoamylase (CL00024074)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtgaggctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaagtggaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 329 - protein, 598 aa, Artificial Sequence
  Synthetic Glucoamylase (CL00024079)
SPVSKRATLDEFISTERPLALERLLCNIGPTGCRASGAASGVVIASPSRSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKDNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 330 - DNA, 1794 bp, Artificial Sequence
  Synthetic Glucoamylase (CL00024079)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaaggataacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 331 - protein, 598 aa, Artificial Sequence
  Synthetic Glucoamylase (CL00024138)
SPVSKRATLDEFISTERPLALERLLCNIGPTGCRASGAASGVVIASPSRSDPDYYYTWTRDAALVFKEIVDSVETNTTLLLPKIENYVTAQAYLQTVTNPSGSLSDGAGLGEPKFNVNMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKWNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 332 - DNA, 1794 bp, Artificial Sequence
  Synthetic Glucoamylase (CL00024138)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccaaagattgagaactacgttactgcccaggcttacctgcagaccgtgacgaacccctcgggttcgctgtcggatggtgctggtctgggcgagcccaagttcaacgtcaatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaagtggaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 333 - protein, 598 aa, Artificial Sequence
  Synthetic Glucoamylase (CL00024162)
SPVSKRATLDEFISTERPLALERLLCNIGPTGCRASGAASGVVIASPSKSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 334 - DNA, 1794 bp, Artificial Sequence
  Synthetic Glucoamylase (CL00024162)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtccaagagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 335 - protein, 598 aa, Artificial Sequence
  Synthetic Glucoamylase (CL00024166)
SPVSKRATLDEFISTERPLALERLLCNIGPEGCRASGAASGVVIASPSRSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKFNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 336 - DNA, 1794 bp, Artificial Sequence
  Synthetic Glucoamylase (CL00024166)
tcgcctgtttccaagcgcgctacgctggacgagttcatcagcaccgagcgtcccttggctctggagcgcctgctctgcaacattggtcctgagggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaagttcaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 337 - protein, 598 aa, Artificial Sequence
  Synthetic Glucoamylase (CL00024191)
SPVSKRATLDEFISTERPLALERLLCNIGPTGCRASGAASGVVIASPSRSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKYNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 338 - DNA, 1794 bp, Artificial Sequence
  Synthetic Glucoamylase (CL00024191)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaagtacaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 339 - protein, 598 aa, Artificial Sequence
  Synthetic Glucoamylase (CL00024274)
SPVSKRATLDEFISTERPLALERLLCNIGPEGCRASGAASGVVIASPSRSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGEALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKWNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 340 - DNA, 1794 bp, Artificial Sequence
  Synthetic Glucoamylase (CL00024274)
tcgcctgtttccaagcgcgctacgctggacgagttcatcagcaccgagcgtcccttggctctggagcgcctgctctgcaacattggtcctgagggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtgaggctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaagtggaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 341 - protein, 598 aa, Artificial Sequence
  Synthetic Glucoamylase (CL00024416)
SPVSKRATLDEFISTERPLALERLLCNIGPEGCRASGAASGVVIASPSKSDPDYYYTWTRDAALVFKEIVDSVETNTTLLLPEIENYVTAQAYLQTVTNPSGSLSDGAGLGEPKFNVDMTAFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKWNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 342 - DNA, 1794 bp, Artificial Sequence
  Synthetic Glucoamylase (CL00024416)
tcgcctgtttccaagcgcgctacgctggacgagttcatcagcaccgagcgtcccttggctctggagcgcctgctctgcaacattggtcctgagggttgccgtgcttcgggagctgcctcgggagtcgttatcgcctcgccgtccaagagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactgccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaagtggaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 343 - protein, 598 aa, Artificial Sequence
  Synthetic Glucoamylase (CL00024548)
SPVSKRATLDEFISTERPLALERLLCNIGPEGCRASGAASGVVIASPSRSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKYNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 344 - DNA, 1794 bp, Artificial Sequence
  Synthetic Glucoamylase (Synthetic Glucoamylase)
tcgcctgtttccaagcgcgctacgctggacgagttcatcagcaccgagcgtcccttggctctggagcgcctgctctgcaacattggtcctgagggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaagtacaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 345 - protein, 598 aa, Artificial Sequence
  Synthetic Glucoamylase (CL00024639)
SPVSKRATLDEFISTERPLALERLLCNIGPTGCRASGAASGVVIASPSKSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGEALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKDNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 346 - DNA, 1794 bp, Artificial Sequence
  Synthetic Glucoamylase (CL00024639)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtccaagagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtgaggctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaaggataacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 347 - protein, 598 aa, Artificial Sequence
  Synthetic Glucoamylase (CL00024696)
SPVSKRATLDEFISTERPLALERLLCNIGPEGCRASGAASGVVIASPSKSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGDALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKFNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGIFLSASSYTASNPLWTTTVSVPQGSTVEFKFIRVGSDGSITWESGNNKVLTVGSSATSVTVSASWNGAYSVSSS

SEQ ID NO: 348 - DNA, 1794 bp, Artificial Sequence
  Synthetic Glucoamylase (CL00024696)
tcgcctgtttccaagcgcgctacgctggacgagttcatcagcaccgagcgtcccttggctctggagcgcctgctctgcaacattggtcctgagggttgccgtgcttcgggagctgcctcgggagtcgttatcgcctcgccgtccaagagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtgatgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaagttcaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattttcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 349 - protein, 598 aa, Artificial Sequence
  Synthetic Glucoamylase (CL00024866)
SPVSKRATLDEFISTERPLALERLLCNIGPEGCRASGAASGVVIASPSRSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGDALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKANGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 350 - DNA, 1794 bp, Artificial Sequence
  Synthetic Glucoamylase (CL00024866)
tcgcctgtttccaagcgcgctacgctggacgagttcatcagcaccgagcgtcccttggctctggagcgcctgctctgcaacattggtcctgagggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtgatgctttggccgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaaggccaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 351 - protein, 598 aa, Artificial Sequence
  Synthetic Glucoamylase (CL00024916)
SPVSKRATLDEFISTERPLALERLLCNIGPTGCRASGAASGVVIASPSRSDPDYYYTWTRDAALVFKEIVDSVETNTTLLLPEIENYVTAQAYLQTVTNPSGSLSDGAGLGEPKFNVDMTPFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGEALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKFNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 352 - DNA, 1794 bp, Artificial Sequence
  Synthetic Glucoamylase (CL00024916)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtgaggctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaagttcaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 353 - protein, 598 aa, Artificial Sequence
  Synthetic Glucoamylase (CL00025095)
SPVSKRATLDEFISTERPLALERLLCNIGPTGCRASGAASGVVIASPSRSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYDKNNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 354 - DNA, 1794 bp, Artificial Sequence
  Synthetic Glucoamylase (CL00025095)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtacgataagaacaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 355 - protein, 598 aa, Artificial Sequence
  Synthetic Glucoamylase (CL00025109)
SPVSKRATLDEFISTERPLALERLLCNIGPEGCRASGAASGVVIASPSRSDPDYYYTWTRDAALVFKEIVDSVETNTTLLLPEIENYVTAQAYLQTVTNPSGSLSDGAGLGEPKFNVDMTPFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKYNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 356 - DNA, 1794 bp, Artificial Sequence
  Synthetic Glucoamylase (CL00025109)
tcgcctgtttccaagcgcgctacgctggacgagttcatcagcaccgagcgtcccttggctctggagcgcctgctctgcaacattggtcctgagggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaagtacaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 357 - protein, 598 aa, Artificial Sequence
  Synthetic Glucoamylase (CL00025145)
SPVSKRATLDEFISTERPLALERLLCNIGPTGCRASGAASGVVIASPSRSDPDYYYTWTRDAALVFKEIVDSVETNTTLLLPEIENYVTAQAYLQTVTNPSGSLSDGAGLGEPKFNVDMTAFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGTALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKYNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 358 - DNA, 1794 bp, Artificial Sequence
  Synthetic Glucoamylase (CL00025145)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactgccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtactgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaagtacaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 359 - protein, 598 aa, Artificial Sequence
  Synthetic Glucoamylase (CL00025216)
SPVSKRATLDEFISTERPLALERLLCNIGPTGCRASGAASGVVIASPSRSDPDYYYTWTRDAALVFKEIVDSVETNTTLLLPEIENYVTAQAYLQTVTNPSGSLSDGAGLGEPKFNVDMTQFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGDALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKWNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 360 - DNA, 1794 bp, Artificial Sequence
  Synthetic Glucoamylase (CL00025216)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcagttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtgatgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaagtggaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 361 - protein, 598 aa, Artificial Sequence
  Synthetic Glucoamylase (CL00025225 G16 TpGlucoamylase G6P)
SPVSKRATLDEFISTERPLALERLLCNIGPTGCRASGAASGVVIASPSRSDPDYYYTWTRDAALVFKEIVDSVETNTTLLLPEIENYVTAQAYLQTVTNPSGSLSDGAGLGEPKFNVDMTPFTGAWGRPQRDGPALRATAMIAYYNYLLNNNATTDCGLWQIIQNDLNYVAQYWNQTGYDLWEEVPGSSFFTVAAQYRALVEGSTLAAKLGKSHSAYDTVAPQILCYLQSFWSSSKGYIVANTQTASWVSRSGLDANTPLTAIHLFDPELGCDDSTFQPCSPKQLITTKKLVDSFRSIYAINSGKSAGDALAVGRYAEDVYYNGNPWYLCTLAVAEQLYDAVYTWKLEGSITVTSVSLPFFTDLLPSLTTGTYASGSTTFESIISAVTTYADGFVSIVQTYTPSDGALSEQYSKYNGQQLSAPDLTWSYAAFLSATERRDSVVPAGWAGASSVSVPGACAATTVVGTYAAASNCGTPGSGSGGNGGSSGNALVTFNELATTYYGENIKLVGSTAAFGSWSPSAGILLSASSYTASNPLWTTTVSVPQGSTVEFKFIRVGSDGSITWESGNNKVLTVGSSATSVTVSASWNGAYSVSSS

SEQ ID NO: 362 - DNA, 1794 bp, Artificial Sequence
  Synthetic Glucoamylase (CL00025225 G16 TpGlucoamylase G6P)
tcgcctgtttccaagcgcgctacgctggacgagttcatcagcaccgagcgtcccttggctctggagcgcctgctctgcaacattggtcctactggttgccgtgcttcgggagctgcctcgggagtcgttatcgcctcgccgtcccgcagcgatccggactactactacacttggacccgtgatgctgctctggtctttaaggagattgtcgactctgtcgagactaacaccactctgctgctgccagagattgagaactacgttactgcccaggcttacctgcagaccgtgacgaacccctcgggttcgctgtcggatggtgctggtctgggcgagcccaagttcaacgtcgatatgactcccttcactggtgcctggggtcgtcctcagcgtgatggtccggctctgcgtgctacggctatgatcgcctactacaactacctgctcaacaacaacgccactaccgactgtggtctgtggcagattatccagaacgacctgaattacgtcgctcagtactggaaccaaactggttacgacctgtgggaggaggttccgggttcatcctttttcactgttgctgctcagtacagagctctcgttgagggttctacccttgctgccaagctcggcaagtctcactcggcctacgacactgtcgctccgcagattctgtgctacttgcagagcttctggtcatccagcaagggctacattgtcgccaacacccagactgccagctgggtctcgcggtccggtcttgatgccaacactcccttgactgccatccacctatttgaccctgaacttggctgcgatgactcgactttccagccctgctcgcccaagcagcttatcactactaagaagctcgttgactcgttccgctccatctatgccatcaactcgggcaagtctgctggtgatgctttggctgttggtcgttacgccgaggacgtctactacaacggcaacccctggtacctgtgcactttggctgttgcagagcagctttacgatgcagtttacacttggaagctcgagggctccatcaccgtcacctctgtctcgctgcccttcttcactgacctgctgccctcgctgaccactggcacctacgcttcgggctcgaccaccttcgaatccatcatctctgctgtgactacctacgctgatggctttgtcagtattgtccagacctacactccctctgacggcgctctgtctgagcagtactccaagtacaacggccagcagctgtcggctcccgacctgacctggtcgtacgccgctttcctatctgccactgagcgccgtgacagcgttgtccctgccggctgggctggtgcctcgtctgtctctgtgcccggcgcctgcgctgctaccaccgttgtcggaacctacgctgctgcctccaactgcggtactcctggctctggctcgggcggcaacggtggctcgagcggtaacgccctggtgactttcaacgagctggctactacctactacggcgagaacattaagcttgtcggcagcacagctgctttcggttcgtggtcgccctcagctggtattctcctgtctgcctcgtcgtacacggccagcaaccctctgtggactaccaccgtgtcggttccccagggctcgaccgttgagttcaagttcatccgtgttggctccgacggcagcatcacgtgggagagcggcaacaacaaggtgttgacggttggctcttcggccacgagcgtcactgtttctgccagctggaacggcgcctactcggtgtctagctct

SEQ ID NO: 363 - DNA, 1961 bp, Artificial Sequence
  Synthetic Glucoamylase (G16G1P-Promoter)
tttttttttttttttttttttttttcatcatctcttgtgtttgttctcggtattatacgcctgaatccgcctacgacccgagaagtatgtggcgaggcaggatttacttacttctctgcattcatgtcgctttttctgtcacctgtattcatctttggatcacctcatcaaaccctcatttgctctcgagtcatgtgtttccttctcttgcaaagcccgctcttgaggtatatctaatctctctcggcttcatttccagcagaaaatggccgagagaaacaacactggacctgaggggcagaataaagtgagactgtgtgatgaggtgatggggctctccaacttcaagtctcaaaggggtatatcagcattggatggagaactagatgtctattaaaagcaaaagggcgtttgggctgcaactggttcaaggctttcacgatggatgaggaaggaaacctcgagatgtgatgttttggcctgtcattcgtaggcaaactccaggtttatactaacttccgttagaccattataattacatacaaagctagcgccagggtgtctacagcaacacacccctacctcattttaacctttcttaatcccgtctttatttctcttcctacgtgttaaggattttgtttaacgcatacacgccatggatatgaataaggaaaaacgttttctcaaagagattaccagctttgatgttgagcatcagaggcgagctcggactcggaagacgccggggcgtctggtgtggtaagtgttcattttcttgacatgattctgtgaacgcctaggcaagtctgtctgttgcctgatctagcgactcgggagtctagagtgagatgaggtgatgtgaggtcagtgtatatatgtatatgcaaaaccaggtccaagttccgttggttgtgttgcagttgcattctcgacctggagaactggaaccggttttcgggccgtttatttcatctctcttttattgacgcgaacatctctattcacccggacatcataaataccacgtcctttttggttcaagtcacaagccaaaggagaagaagagaaagaataacccgaggaaaataaacagccgtcacaaattcggggcagtcgtgtggggaaagaaccaaatatggggttgcgagtattatgtaatacagacgacaaggggttaaaaaagaggaaggaacttgccccggatgctgcactcttctcgggcgtcattaccattcttgtctttttgtttttcatgctccatgctggcatgtgattgtggcctcttctcctccttgttttcgtctttcatgtcggtctttgatcatcgtctctatcaccttctctcatcttctctctttctttctcttcctttctcctggcagccttatatccttcgtcttcgaaaagtccatagccgctatctatgtatacaccagccccatcctttctgtcgagtctggctctctccaacgcggctctagcactaccccttgccatgctctttcttcatcaaataagaaaacaaaaacgcatctggttcctcttgtctcgtcacataccgccgcactttccttcccgggcatagctgagccttggtccagtcggccctttcctgaatccatgacttcatgtcgccctttttggaggttgtatcgtggaggttgagtttagcctgccattcattgcaataccgtcttgctcactattgcaaacatgctgcaatatagactcggactctcttagatcgtgtcactcggtcttgaaatccatcacgatattgttgactgaccatttctatatctagggcctttgtctgcctctccttcgtttccttctccctctctcttctctccaccaagcaaagcttctcttcgtcttctctagacacttccagcttgtctgcctgctcctcttcctctgctcttgtctgcttgctttctgcgcctgctactgcaata

What is claimed is:

1. A composition comprising a glucoamylase enzyme having an amino acid sequence selected from the group consisting of SEQ ID NO:207, SEQ ID NO:307 and SEQ ID NO:361.

2. A nucleic acid encoding a glucoamylase enzyme having an amino acid sequence selected from the group consisting of SEQ ID NO:3, SEQ ID NO:5, SEQ ID NO:207, SEQ ID NO:307 and SEQ ID NO:361.

3. An expression vector comprising a nucleic acid according to claim 2.

4. A host cell comprising a nucleic acid according to claim 2.

5. A host cell comprising an expression vector according to claim 3.

6. A method of carbohydrate saccharification from a starch substrate comprising contacting said substrate with a glucoamylase enzyme having an amino acid sequence selected from the group consisting of SEQ ID NO:207, SEQ ID NO:307 and SEQ ID NO:361, wherein said starch is degraded.

* * * * *